(12) United States Patent
Van Allen et al.

(10) Patent No.: US 11,377,697 B2
(45) Date of Patent: Jul. 5, 2022

(54) BIOMARKERS PREDICTIVE OF ANTI-IMMUNE CHECKPOINT RESPONSE

(71) Applicant: Dana-Farber Cancer Institute, Inc., Boston, MA (US)

(72) Inventors: Eliezer Van Allen, Brookline, MA (US); Diana Miao, Newton, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 289 days.

(21) Appl. No.: 16/475,577

(22) PCT Filed: Jan. 9, 2018

(86) PCT No.: PCT/US2018/012936
§ 371 (c)(1),
(2) Date: Jul. 2, 2019

(87) PCT Pub. No.: WO2018/132369
PCT Pub. Date: Jul. 19, 2018

(65) Prior Publication Data
US 2019/0338370 A1    Nov. 7, 2019

Related U.S. Application Data

(60) Provisional application No. 62/445,105, filed on Jan. 11, 2017.

(51) Int. Cl.
*C12Q 1/6886*    (2018.01)
*G01N 33/50*    (2006.01)
*G01N 33/574*    (2006.01)

(52) U.S. Cl.
CPC ....... *C12Q 1/6886* (2013.01); *G01N 33/5011* (2013.01); *G01N 33/57484* (2013.01); *C12Q 2600/106* (2013.01); *C12Q 2600/156* (2013.01); *C12Q 2600/158* (2013.01)

(58) Field of Classification Search
CPC .................................................... C12Q 1/6886
USPC ...................................................... 424/174.1
See application file for complete search history.

(56) References Cited

FOREIGN PATENT DOCUMENTS

| WO | WO-2015/164743 A2 | 10/2015 |
|---|---|---|
| WO | WO-2016/196298 A1 | 12/2016 |
| WO | WO-2017/151502 A1 | 9/2017 |
| WO | WO-2017/161208 A1 | 9/2017 |
| WO | WO-2018/132369 A1 | 7/2018 |

OTHER PUBLICATIONS

Tockman et al (Cancer Res., 1992, 52:2711s-2718s).*
Manceau et al (Int J Cancer, 2013, 132: 2217-2221).*
Hodis et al (Cell, 2012, 150(2): 251-2Hodis et al (Cell, 2012, 150(2): 251-263)63).*
Li et al. (Nature Genetics, 2011, 43(9): 828-829).*
Warner et al. (Case Reports in Oncological Medicine, 2015, 893694, 8 pages).*
Saleh et al (Leukemia, 2017, 31: 340-349; published online Jul. 19, 2016).*
International Search Report and Written Opinion for International Application No. PCT/US18/12936 dated Apr. 13, 2018.
Kardos et al., "Claudin-low bladder tumors are immune infiltrated and actively immune suppressed," JCI Insight, 1(3): 1-17 (2016).

* cited by examiner

*Primary Examiner* — Sean E Aeder
(74) *Attorney, Agent, or Firm* — Foley Hoag LLP

(57) ABSTRACT

The present invention is based on the identification of novel biomarkers predictive of responsiveness to anti-immune checkpoint therapies.

13 Claims, 24 Drawing Sheets

Specification includes a Sequence Listing.

Figure 1

Included samples:
Passed whole exome sequencing quality control

| Cancer Type | Number of Pre-Treatment Tumor Samples | Source |
|---|---|---|
| Anal | 1 | DFCI (1) |
| Bladder | 13 | DFCI (9)<br>DFCI CCPM (4) |
| HNSCC | 14 | DFCI (14) |
| Lung | 67 | DFCI SU2C (31)<br>CANSEQ (1)<br>Rizvi (34 – MAF only)<br>PD-L1 (1) |
| Melanoma | 176 | BroadNext10 (5)<br>Schadendorf (97)<br>Rizwan Haq (2)<br>Snyder (34 – MAF only)<br>Hugo (34 – MAF only)<br>Zaretsky (4) |
| Sarcoma | 1 | DFCI (1) |
| Total | 272 | |

Figure 2

Quality Control

- Exclusion Criteria:
  - Limited contamination with non-patient DNA:
    - Contamination Estimation (ContEst) < 5%
  - Limited admixture between tumor and normal DNA:
    - CopyNumberQC < 5 mix-ups
  - Mean target coverage:
    - Tumor: <25x
    - Normal: <15x
  - Estimated purity (ABSOLUTE) <10%
- Inclusion Criteria:
  - At least 1 clonal driver mutation (Tamborero et al. 2013)
    - RCC-CA209009_5_73 included despite not having any clonal driver mutations
  - Sequencing from pre-treatment patient tumor: Excluded on-treatment and post-treatment tumors from Snyder et al. and Hugo et al.
  - Patient received immune checkpoint therapy without combination targeted therapy (e.g. vemurafenib, dacarbazine, carboplatin, etc.)
    - Patients receiving combination immune checkpoint therapy (e.g. anti-PD1 blockade with anti-CTLA4 blockade) were included

Figure 3

Clinical benefit from immune checkpoint therapy
N=268 patients  *36 not shown due to incomplete survival data

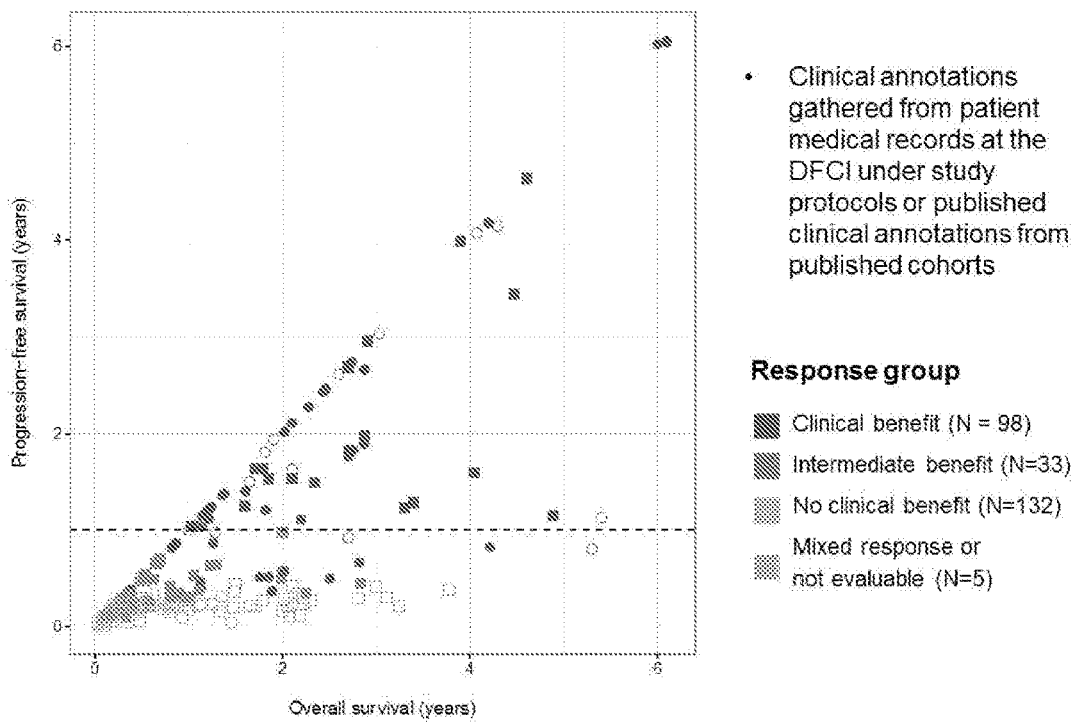

- Clinical annotations gathered from patient medical records at the DFCI under study protocols or published clinical annotations from published cohorts

Response group

- Clinical benefit (N = 98)
- Intermediate benefit (N=33)
- No clinical benefit (N=132)
- Mixed response or not evaluable (N=5)

SWI/SNF Complex

- SWI/SNF complex: ATP-dependent chromatin remodeling complexes mutated in >20% of human cancers
  - BAF:
    - BAF250A (ARID1A)
    - BAF250B (ARID1B)
    - BAF57 (SMARCE1)
    - BAF190/BRM (SMARCA2)
    - BAF47 (SMARCB1)
    - BAF53A (ACTL6A)
  - PBAF:
    - BAF200 (ARID2)
    - BAF180 (PBRM1)
    - BRD7
    - BAF45A (PHF10)
  - Shared:
    - BRG1/BAF190 (SMARCA4)
    - BAF155 (SMARCC1)
    - BAF170 (SMARCC2)

BAF            PBAF

Figure 13
A
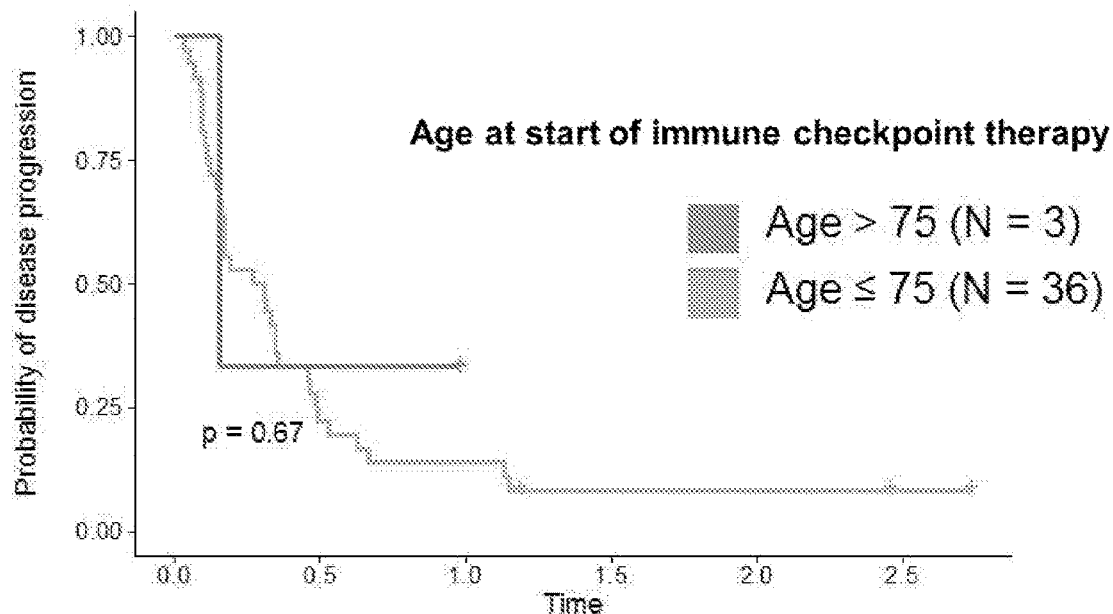
B
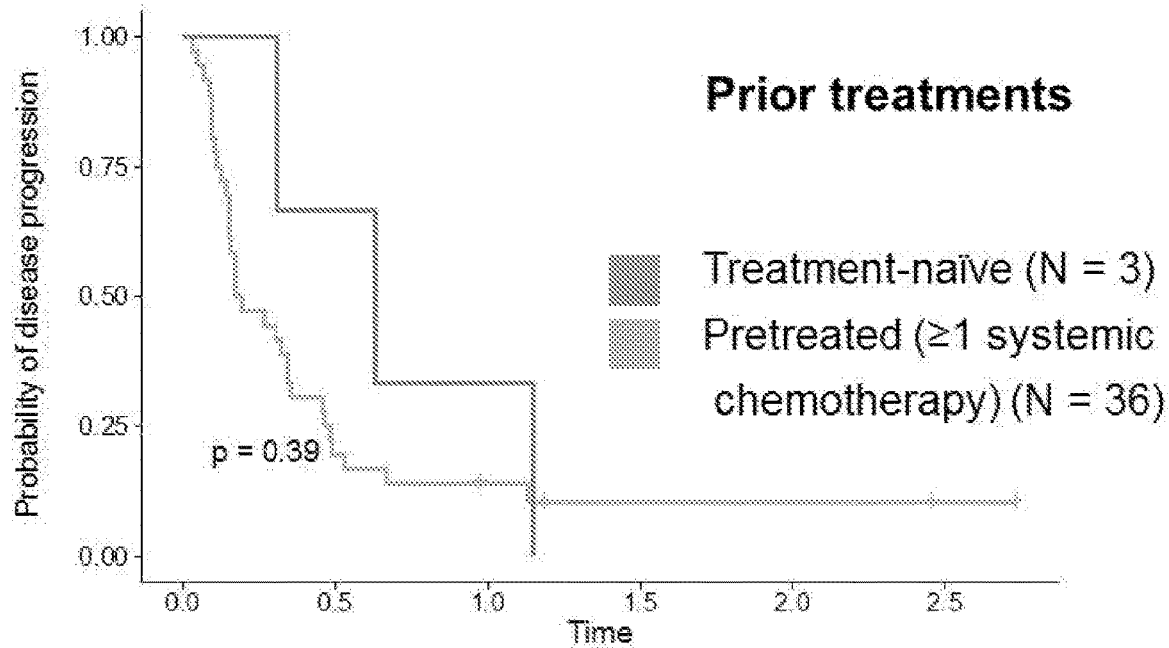

Figure 13 (cont.)
C
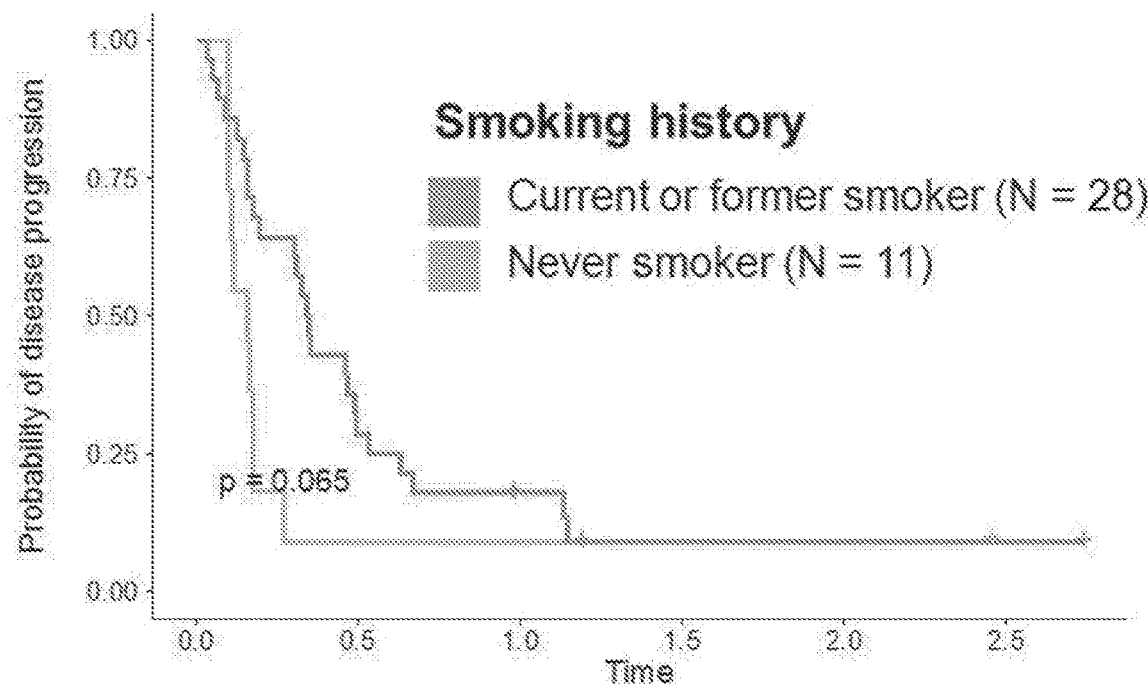
D
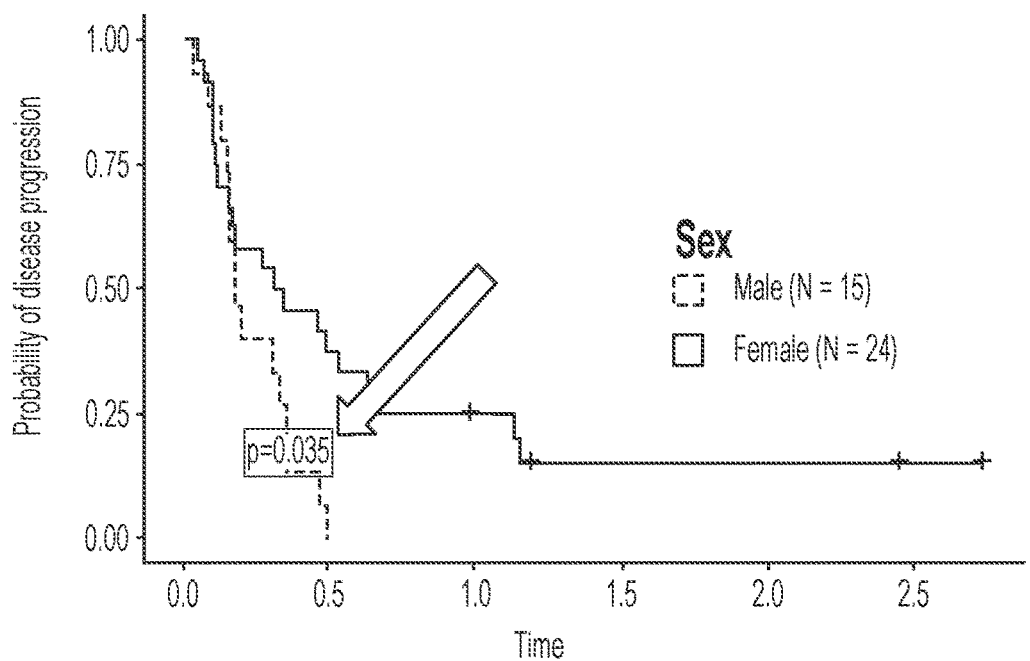

Figure 14

Quality Control 39 pre-treatment tumors underwent whole exome sequencing

ContEst: Evaluation for sample contamination with non-patient genomic material (<10%)
- 1 patient excluded: SU2C-1009 (SD)

CopyNumberQC: Evaluation for normal contamination in tumor sample (<5 mix-ups)
- 1 patient excluded: LUAD-B5-12-M17368 (PR)

Mean target coverage: Evaluation for adequate sequencing coverage to detect mutations (MTC > 30x for tumor and 15x for normal)
- 2 patients excluded: SU2C-1012 (PR), SU2C-1014 (PD)
  - 2nd pre-treatment tumor from LUAD-1011 also excluded

ABSOLUTE: Evaluation for adequate sample purity to detect somatic mutations (>10% tumor cells)
- 4 patients excluded: SU2C-1019 (PD), SU2C-1015 (PD), SU2C-1008 (PD), SU2C-1001 (SD)

31 pre-treatment tumors included in final analysis
- Plus 1 additional pre-treatment tumor from LUAD-1007 and 3 additional post-progression tumors from LUAD-1020

Figure 22 (cont.)

BIOMARKERS PREDICTIVE OF ANTI-IMMUNE CHECKPOINT RESPONSE

CROSS-REFERENCE TO RELATED APPLICATIONS

This application is the U.S. national phase of International Patent Application No. PCT/US2018/012936, filed on Jan. 9, 2018, which claims the benefit of priority to U.S. Provisional Application Ser. No. 62/445,105, filed on 11 Jan. 2017; the entire contents of each of said applications are incorporated herein in their entirety by this reference.

BACKGROUND OF THE INVENTION

Immune checkpoint therapies can yield durable responses and long-lasting survival benefit across some cancer types (Topalian et al. (2015) *Cancer Cell* 27:450-461). Indeed, checkpoint therapies have been approved for use in metastatic melanoma, non-small cell lung cancer, bladder cancer, and renal cell carcinoma, including as a first-line therapy for non-small cell lung cancer. However, many subjects among a population of subjects having the same cancer type do not exhibit a therapeutic benefit or relapse despite being treated with the same immune checkpoint therapy. It is presently unclear which factors associated with a cancer or type thereof, such as mutational load, neoantigen presentation, transcriptomic signatures, microbiome features, immune cell infiltration, or other indicators, are predictive of response to immune checkpoint therapies. Accordingly, there remains a great need in the art to identify biomarkers predictive of immune checkpoint therapy in order to better treat cancer of subjects in need thereof.

SUMMARY OF THE INVENTION

The present invention is based, at least in part, on the discovery that alterations in multiple oncogenic signaling pathways, including SWI/SNF pathway but also other chromatin modifiers, such as KDM6A, and EGFR signaling, predict response or resistance to immune checkpoint therapies, including (but not limited to) monoclonal antibodies targeting PD-1, PD-L1, and CTLA-4, across multiple cancer types. The SWI/SNF chromatin remodeling complex, which contains ARID1A, ARID1B, ARID2, SMARCA2, SMARCA4, SMARCB1, and PBRM1 subunits, among other subunits, plays a role in replication, transcription, DNA repair, and control of cell proliferation and differentiation. Although alterations in SWI/SNF subunits are known to play a role in the pathogenesis of ~20% of human cancers, including clear cell renal cell carcinoma, lung cancer, squamous cell carcinomas, hepatocellular carcinoma, small cell lung cancer, colorectal cancer, and pancreatic cancer (Kadoch and Crabtree (2015) *Sci. Adv.* 1:e150047), it was heretofore unknown that a mutation in one or more subunits of the SWI/SNF complex (e.g., mutations in one or more subunits of the PBAF complex, such as PBRM1 and ARID2), is predictive of response to immune checkpoint inhibitors. The same lack of predictive response applies to mutations in certain chromatin modifiers, such as KDM6A, and certain EGFR signaling components described herein. Since mutations in certain SWI/SNF complex subunits, chromatin modifiers, and/or EGFR signaling components described herein are found within a variety of cancers and types thereof, including bladder cancer, renal cell carcinoma, lung cancer, and head and neck squamous cell carcinoma, these biomarkers have wide-ranging implications for patient stratification for immune checkpoint therapy across a wide variety of hyperproliferative disorders.

In one aspect, a method of identifying the likelihood of a cancer in a subject to be responsive to an immune checkpoint therapy, the method comprising a) obtaining or providing a subject sample from a patient having cancer; b) measuring the amount or activity of at least one biomarker listed in Table 1 in the subject sample; and c) comparing said amount or activity of the at least one biomarker listed in Table 1 in a control sample, wherein the absence of or a significantly decreased amount or activity of the at least one biomarker listed in Table 1 in the subject sample and/or the presence of or a significantly increased amount or activity of the at least one biomarker listed in Table 1 having a loss of function mutation in the subject sample, relative to the control sample identifies the cancer as being more likely to be responsive to the immune checkpoint therapy; and wherein the presence of or a significantly increased amount or activity of the at least one biomarker listed in Table 1 in the subject sample and/or the absence of or a decreased amount or activity of the at least one biomarker listed in Table 1 having a loss of function mutation in the subject sample, relative to the control sample identifies the cancer as being less likely to be responsive to the immune checkpoint therapy, is provided.

In another aspect, a method of identifying the likelihood of a cancer in a subject to be responsive to immune checkpoint therapy, the method comprising a) obtaining or providing a subject sample from a patient having cancer, wherein the sample comprises nucleic acid molecules from the subject; b) determining the copy number of at least one biomarker listed in Table 1 in the subject sample; and c) comparing said copy number to that of a control sample, wherein a decreased copy number of the at least one biomarker listed in Table 1 in the in the subject sample and/or an increased copy number of the at least one biomarker listed in Table 1 having a loss of function mutation in the subject sample, relative to the control sample identifies the cancer as being more likely to be responsive to the immune checkpoint therapy; and wherein a wild type or increased copy number of the biomarker in the subject sample and/or or a decreased copy number of the at least one biomarker listed in Table 1 having a loss of function mutation in the sample relative to the control sample identifies the cancer as being less likely to be responsive to the immune checkpoint therapy, is provided.

Numerous embodiments are further provided that can be applied to any aspect of the present invention and/or combined with any other embodiment described herein. For example, in one embodiment, the method provided herein further comprises recommending, prescribing, or administering the immune checkpoint therapy if the cancer is determined likely to be responsive to the immune checkpoint therapy or administering an anti-cancer therapy other than the immune checkpoint therapy if the cancer is determined be less likely to be responsive to the immune checkpoint therapy. The anti-cancer therapy may be, for example, selected from the group consisting of targeted therapy, chemotherapy, radiation therapy, and/or hormonal therapy. In another embodiment, the control sample described herein is determined from a cancerous or non-cancerous sample from either the patient or a member of the same species to which the patient belongs. In still another embodiment, the control sample is a cancerous or non-cancerous sample from the patient obtained from an earlier point in time than the patient sample. In yet another embodiment, the control sample is obtained before the patient has received immune checkpoint therapy and the patient sample is obtained after the patient has received immune checkpoint therapy. In another embodiment, the control sample described herein comprises cells or does not comprise cells. In still another embodiment, the control sample comprises cancer cells known to be responsive or non-responsive to the immune checkpoint therapy.

In another aspect, a method of assessing the efficacy of an agent for treating a cancer in a subject that is unlikely to be responsive to an immune checkpoint therapy, comprising a) detecting in a first subject sample and maintained in the presence of the agent the amount or activity of at least one biomarker listed in Table 1; b) detecting the amount or activity of the at least one biomarker listed in Table 1 in a second subject sample and maintained in the absence of the test compound; and c) comparing the amount or activity of the at least one biomarker listed in Table 1 from steps a) and b), wherein the presence of or a significantly increased amount or activity of the at least one biomarker listed in Table 1 in the first subject sample and/or the absence of or a decreased amount or activity of the at least one biomarker listed in Table 1 having a loss of function mutation in the first subject sample, relative to at least one subsequent subject sample, indicates that the agent treats the cancer in the subject, is provided.

In another aspect, a method of assessing the efficacy of an agent for treating a cancer in a subject or prognosing progression of a cancer in a subject, comprising a) detecting in a subject sample at a first point in time the amount or activity of at least one biomarker listed in Table 1; b) repeating step a) during at least one subsequent point in time after administration of the agent; and c) comparing the expression and/or activity detected in steps a) and b), wherein the presence of or a significantly increased amount or activity of the at least one biomarker listed in Table 1 in the first subject sample and/or the absence of or a decreased amount or activity of the at least one biomarker listed in Table 1 having a loss of function mutation in the first subject sample, relative to at least one subsequent subject sample, indicates that the cancer is unlikely to progress or that the agent treats the cancer in the subject, is provided. In one embodiment, between the first point in time and the subsequent point in time, the subject has undergone treatment, completed treatment, and/or is in remission for the cancer. In another embodiment, the first and/or at least one subsequent sample is selected from the group consisting of ex vivo and in vivo samples. In still another embodiment, the first and/or at least one subsequent sample is obtained from an animal model of the cancer. In yet another embodiment, the first and/or at least one subsequent sample is a portion of a single sample or pooled samples obtained from the subject.

In another aspect, a cell-based assay for screening for agents that have a cytotoxic or cytostatic effect on a cancer cell that is unresponsive to an immune checkpoint therapy comprising, contacting the cancer cell with a test agent, and determining the ability of the test agent to decrease the amount or activity of at least one biomarker listed in Table 1 in the subject sample and/or increase the amount or activity of the at least one biomarker listed in Table 1 having a loss of function mutation, is provided. In one embodiment, the step of contacting occurs in vivo, ex vivo, or in vitro. In another embodiment, the subject sample and/or the control sample has not been contacted with any anti-cancer treatment or inhibitor of an immune checkpoint. In still another embodiment, the subject has not been administered any anti-cancer treatment or inhibitor of an immune checkpoint.

In yet another embodiment, the method or the cell-based assay provided herein further comprises recommending, prescribing, or administering at least one additional anti-cancer therapeutic agent. In another embodiment, the at least one additional anti-cancer therapeutic agent comprises an anti-PD-1 antibody and/or an anti-CTLA4 antibody.

As described above, numerous embodiments are contemplated for any aspect of the present invention described herein. For example, in one embodiment, the subject sample is selected from the group consisting of serum, whole blood, plasma, urine, cells, cell lines, and biopsies. In another embodiment, the amount of the at least one biomarker listed in Table 1 is detected using a reagent which specifically binds with the protein. For example, the reagent may be selected from the group consisting of an antibody, an antibody derivative, and an antibody fragment. In still another embodiment, the at least one biomarker listed in Table 1 is assessed by detecting the presence in the sample of a transcribed polynucleotide or portion thereof. For example, the transcribed polynucleotide may be an mRNA or a cDNA. The transcribed polynucleotide cam be detected by identifying a nucleic acid that anneals with the biomarker nucleic acid, or a portion thereof, under stringent hybridization conditions. In yet another embodiment, the step of detecting further comprises amplifying the transcribed polynucleotide. In another embodiment, the at least one biomarker listed in Table 1 is human PBRM1, ARID2, BRD7, PHF10, KDM6A, ARID1A, ARID1B, BRG1, BRM, CRB1, or EGFR, or a fragment thereof. In still another embodiment, the immune checkpoint therapy described herein comprises at least one antibody selected from the group consisting of anti-PD-1 antibodies, anti-CTLA-4 antibodies, anti-PD-L1 antibodies, anti-PD-L2 antibodies, and combinations thereof. For example, the immune checkpoint therapy may comprise an anti-PD-1 antibody and/or an anti-CTLA4 antibody. In yet another embodiment, the likelihood of the cancer in the subject to be responsive to immune checkpoint therapy is the likelihood of at least one criteria selected from the group consisting of cellular proliferation, tumor burden, m-stage, metastasis, progressive disease, clinical benefit rate, survival until mortality, pathological complete response, semi-quantitative measures of pathologic response, clinical complete remission, clinical partial remission, clinical stable disease, recurrence-free survival, metastasis free survival, disease free survival, circulating tumor cell decrease, circulating marker response, and RECIST criteria. In another embodiment, the cancer is a solid tumor. In still another embodiment, the cancer is selected from the group consisting of melanoma, lung cancer, head and neck squamous cell carcinoma (HNSCC), sarcoma, bladder cancer, and renal cell cancer. In another embodiment, the cancer is melanoma. In still another embodiment, the cancer is metastatic. In still another embodiment, the subject described herein is a mammal. In yet another embodiment, the mammal is an animal model of cancer. In another embodiment, the mammal is a human.

BRIEF DESCRIPTION OF FIGURES

FIG. 1 summarizes the different types of cancer samples and their sources for analysis.

FIG. 2 depicts two criteria (exclusion and inclusion) for selecting quality controls for analysis.

FIG. 3 depicts that different patients had different degrees of clinical benefit from immune checkpoint therapy.

FIG. 13 includes 4 panels, identified as panels A, B, C, and D, which show the Kaplan-Meier analysis result for baseline clinical variables as predictors of PFS for SU2C cohort (N=39).

FIG. 14 shows the quality control processes for analyzing the SU2C cohort.

DETAILED DESCRIPTION OF THE INVENTION

Figure 4:
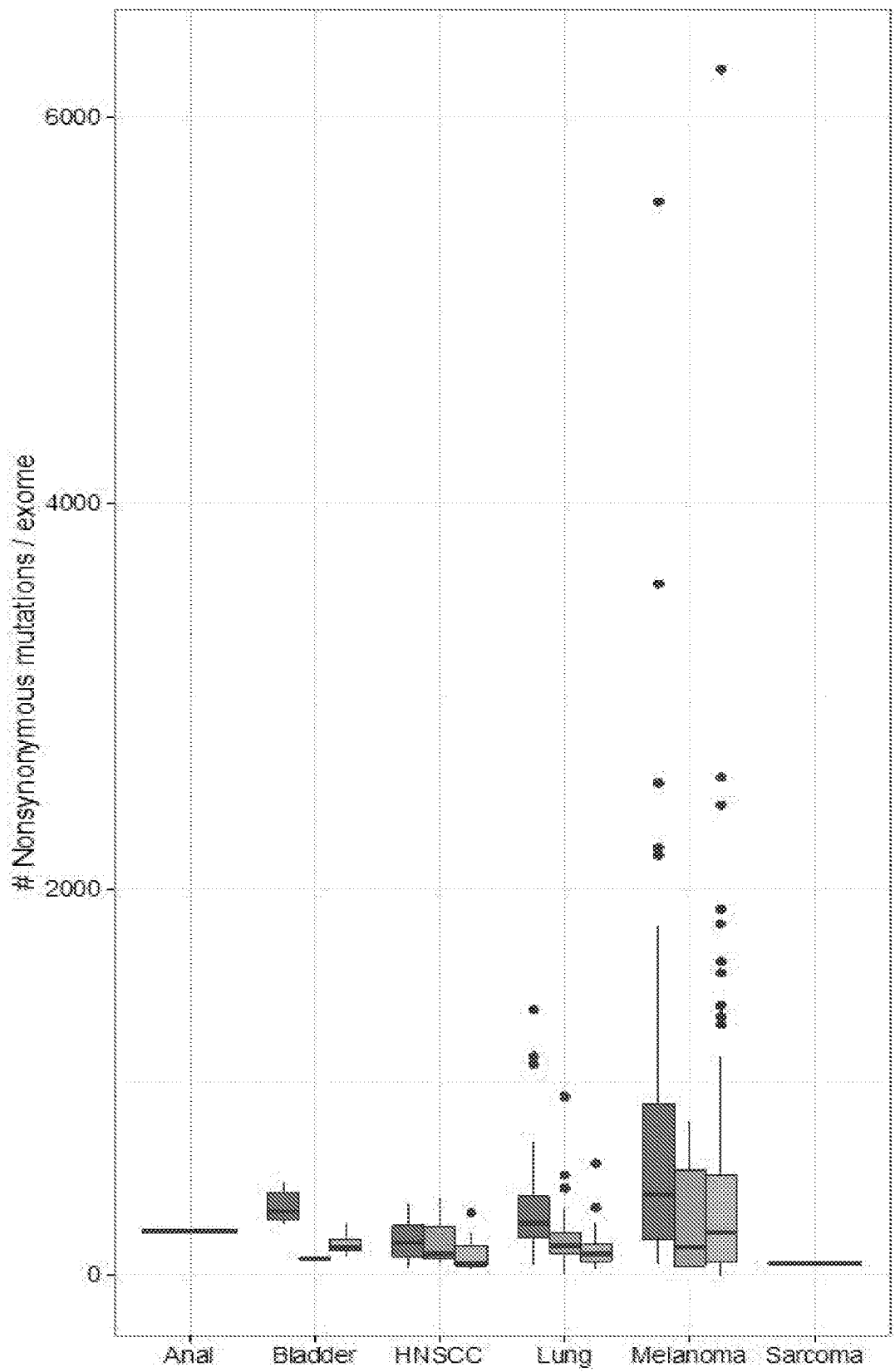
FIG. 4 compares the amount of nonsynonymous mutations in patients having different degrees of clinical benefit from immune checkpoint therapy.

It has been determined herein that certain SWI/SNF complex subunits (e.g., PBRM1, ARID2, and other SWI/SNF complex subunits described herein, such as in the Tables and Examples), additional chromatin modifiers (e.g., such as KDM6A), and EGFR signaling components are specific biomarkers for predicted clinical outcome in a wide variety of cancers afflicting patients who have received anti-immune checkpoint-based therapy (e.g., anti-PD1 and/or anti-CTLA4 agents). Accordingly, the present invention relates, in part, to methods for stratifying patients and predicting response of a cancer in a subject to immune checkpoint therapy based upon a determination and analysis of mutations, described herein, of biomarkers, compared to a control. In addition, such analyses can be used in order to provide useful anti-immune checkpoint treatment regimens (e.g., based on predictions of clinical response, subject survival or relapse, timing of adjuvant or neoadjuvant treatment, etc.).

I. Definitions

The articles "a" and "an" are used herein to refer to one or to more than one (i.e. to at least one) of the grammatical object of the article. By way of example, "an element" means one element or more than one element.

The term "altered amount" or "altered level" refers to increased or decreased copy number (e.g., germline and/or somatic) of a biomarker nucleic acid, e.g., increased or decreased expression level in a cancer sample, as compared to the expression level or copy number of the biomarker nucleic acid in a control sample. The term "altered amount" of a biomarker also includes an increased or decreased protein level of a biomarker protein in a sample, e.g., a cancer sample, as compared to the corresponding protein level in a normal, control sample. Furthermore, an altered amount of a biomarker protein may be determined by detecting posttranslational modification such as methylation status of the marker, which may affect the expression or activity of the biomarker protein.

The amount of a biomarker in a subject is "significantly" higher or lower than the normal amount of the biomarker, if the amount of the biomarker is greater or less, respectively, than the normal level by an amount greater than the standard error of the assay employed to assess amount, and preferably at least 20%, 30%, 40%, 50%, 60%, 70%, 80%, 90%, 100%, 150%, 200%, 300%, 350%, 400%, 500%, 600%, 700%, 800%, 900%, 1000% or than that amount. Such "significance" can be assessed from any desired or known point of comparison, such as a particular post-treatment versus pre-treatment biomarker measurement ratio (e.g., 1-fold, 1.1-fold, 1.2-fold, 1.3-fold, 1.4-fold, 1.5-fold, and the like) or a particular pre-treatment serum biomarker protein measurement (e.g., 2,500 pg/ml, 2,750 pg/ml, 3,000 pg/ml, 3,175 pg/ml, 3,250 pg/ml, 3,500 pg/ml, and the like). Alternately, the amount of the biomarker in the subject can be considered "significantly" higher or lower than the normal amount if the amount is at least about two, and preferably at least about three, four, or five times, higher or lower, respectively, than the normal amount of the biomarker. Such "significance" can also be applied to any other measured parameter described herein, such as for expression, inhibition, cytotoxicity, cell growth, and the like.

The term "altered level of expression" of a biomarker refers to an expression level or copy number of the biomarker in a test sample, e.g., a sample derived from a patient suffering from cancer, that is greater or less than the standard error of the assay employed to assess expression or copy number, and is preferably at least twice, and more preferably three, four, five or ten or more times the expression level or copy number of the biomarker in a control sample (e.g., sample from a healthy subjects not having the associated disease) and preferably, the average expression level or copy number of the biomarker in several control samples. The altered level of expression is greater or less than the standard error of the assay employed to assess expression or copy number, and is preferably at least 20%, 30%, 40%, 50%, 60%, 70%, 80%, 90%, 100%, 150%, 200%, 300%, 350%, 400%, 500%, 600%, 700%, 800%, 900%, 1000% or more times the expression level or copy number of the biomarker in a control sample (e.g., sample from a healthy subjects not having the associated disease) and preferably, the average expression level or copy number of the biomarker in several control samples.

The term "altered activity" of a biomarker refers to an activity of the biomarker which is increased or decreased in a disease state, e.g., in a cancer sample, as compared to the activity of the biomarker in a normal, control sample. Altered activity of the biomarker may be the result of, for example, altered expression of the biomarker, altered protein level of the biomarker, altered structure of the biomarker, or, e.g., an altered interaction with other proteins involved in the same or different pathway as the biomarker or altered interaction with transcriptional activators or inhibitors.

The term "altered structure" of a biomarker refers to the presence of mutations or allelic variants within a biomarker nucleic acid or protein, e.g., mutations which affect expression or activity of the biomarker nucleic acid or protein, as compared to the normal or wild-type gene or protein. For example, mutations include, but are not limited to substitutions, deletions, or addition mutations. Mutations may be present in the coding or non-coding region of the biomarker nucleic acid.

Figure 9:
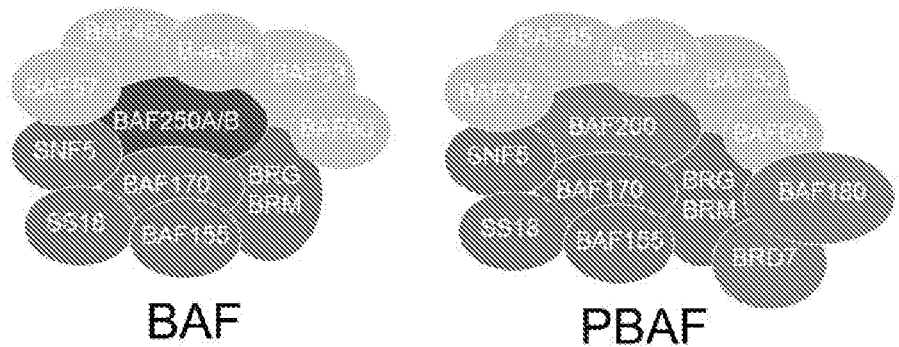
FIG. 9 depicts protein subunits of the SWI/SNF protein complex.

The term "SWI/SNF complex" refers to SWItch/Sucrose Non-Fermentable, a nucleosome remodeling complex found in both eukaryotes and prokaryotes (Neigeborn Carlson (1984) *Genetics* 108:845-858; Stern et al. (1984) *J. Mol. Biol.* 178:853-868). The SWI/SNF complex was first discovered in the yeast, *Saccharomyces cerevisiae*, named after yeast mating types switching (SWI) and sucrose nonfermenting (SNF) pathways (Workman and Kingston (1998) *Annu Rev Biochem.* 67:545-579; Sudarsanam and Winston (2000) *Trends Genet.* 16:345-351). It is a group of proteins comprising, at least, SWI1, SWI2/SNF2, SWI3, SWI5, and SWIG, as well as other polypeptides (Pazin and Kadonaga (1997) *Cell* 88:737-740). A genetic screening for suppressive mutations of the SWI/SNF phenotypes identified different histones and chromatin components, suggesting that these proteins were possibly involved in histone binding and chromatin organization (Winston and Carlson (1992) *Trends Genet.* 8:387-391). Biochemical purification of the SWI/SNF2p in *S. cerevisiae* demonstrated that this protein was part of a complex containing an additional 11 polypeptides, with a combined molecular weight over 1.5 MDa. The SWI/SNF complex contains the ATPase Swi2/Snf2p, two actin-related proteins (Arp7p and Arp9) and other subunits involved in DNA and protein-protein interactions. The purified SWI/SNF complex was able to alter the nucleosome structure in an ATP-dependent manner (Workman and Kingston (1998), supra; Vignali et al. (2000) *Mol Cell Biol.* 20:1899-1910). The structures of the SWI/SNF and RSC complexes are highly conserved but not identical, reflecting an increasing complexity of chromatin (e.g., an increased genome size, the presence of DNA methylation, and more complex genetic organization) through evolution. For this reason, the SWI/SNF complex in higher eukaryotes maintains core components, but also substitute or add on other components with more specialized or tissue-specific domains. Yeast contains two distinct and similar remodeling complexes, SWI/SNF and RSC (Remodeling the Structure of Chromatin). In *Drosophila*, the two complexes are called BAP (Brahma Associated Protein) and PBAP (Polybromo-associated BAP) complexes. The human analogs are BAF (Brg1 Associated Factors, or SWI/SNF-A) and PBAF (Polybromo-associated BAF, or SWI/SNF-B). As shown in FIG. 9, the BAF complex comprises, at least, BAF250A (ARID1A), BAF250B (ARID1B), BAF57 (SMARCE1), BAF190/BRM (SMARCA2), BAF47 (SMARCB1), BAF53A (ACTL6A), BRG1/BAF190 (SMARCA4), BAF155 (SMARCC1), and BAF170 (SMARCC2). The PBAF complex comprises, at last, BAF200 (ARID2), BAF180 (PBRM1), BRD7, BAF45A (PHF10), BRG1/BAF190 (SMARCA4), BAF155 (SMARCC1), and BAF170 (SMARCC2). As in *Drosophila*, human BAF and PBAF share the different core components BAF47, BAF57, BAF60, BAF155, BAF170, BAF45 and the two actins b-Actin and BAF53 (Mohrmann and Verrijzer (2005) *Biochim Biophys Acta.* 1681:59-73). The central core of the BAF and PBAF is the ATPase catalytic subunit BRG1/hBRM, which contains multiple domains to bind to other protein subunits and acetylated histones. For a summary of different complex subunits and their domain structure, see Tang et al. (2010) *Prog Biophys Mol Biol.* 102:122-128 (e.g., FIG. 3), Hohmann and Vakoc (2014) *Trends Genet.* 30:356-363 (e.g., FIG. 1), and Kadoch and Crabtree (2015) *Sci. Adv.* 1:e1500447. For chromatin remodeling, the SWI/SNF complex use the energy of ATP hydrolysis to slide the DNA around the nucleosome. The first step consists in the binding between the remodeler and the nucleosome. This binding occurs with nanomolar affinity and reduces the digestion of nucleosomal DNA by nucleases. The 3-D structure of the yeast RSC complex was first solved and imaged using negative stain electron microscopy (Asturias et al. (2002) *Proc Natl Acad Sci USA* 99:13477-13480). The first Cryo-EM structure of the yeast SWI/SNF complex was published in 2008 (Dechassa et al. 2008). DNA footprinting data showed that the SWI/SNF complex makes close contacts with only one gyre of nucleosomal DNA. Protein crosslinking showed that the ATPase SWI2/SNF2p and Swi5p (the homologue of Ini1p in human), Snf6, Swi29, Snfl1 and Sw82p (not conserved in human) make close contact with the histones. Several individual SWI/SNF subunits are encoded by gene families, whose protein products are mutually exclusive in the complex (Wu et al. (2009) *Cell* 136:200-206). Thus, only one paralog is incorporated in a given SWI/SNF assembly. The only exceptions are BAF155 and BAF170, which are always present in the complex as homo- or hetero-dimers. Combinatorial association of SWI/SNF subunits could in principle give rise to hundreds of distinct complexes, although the exact number has yet to be determined (Wu et al. (2009), supra). Genetic evidence suggests that distinct subunit configurations of SWI/SNF are equipped to perform specialized functions. As an example, SWI/SNF contains one of two ATPase subunits, BRG1 or BRM/SMARCA2, which share 75% amino acid sequence identity (Khavari et al. (1993) *Nature* 366:170-174). While in certain cell types BRG1 and BRM can compensate for loss of the other subunit, in other contexts these two ATPases perform divergent functions (Strobeck et al. (2002) *J Biol Chem.* 277:4782-4789; Hoffman et al. (2014) *Proc Natl Acad Sci USA.* 111:3128-3133). In some cell types, BRG1 and BRM can even functionally oppose one another to regulate differentiation (Flowers et al. (2009) *J Biol Chem.* 284:10067-10075). The functional specificity of BRG1 and BRM has been linked to sequence variations near their N-terminus, which have different interaction specificities for transcription factors (Kadam and Emerson (2003) *Mol Cell.* 11:377-389). Another example of paralogous subunits that form mutually exclusive SWI/SNF complexes are ARID1A/BAF250A, ARID1B/BAF250B, and ARID2/BAF200. ARID1A and ARID1B share 60% sequence identity, but yet can perform opposing functions in regulating the cell cycle, with MYC being an important downstream target of each paralog (Nagl et al. (2007) *EMBO J.* 26:752-763). ARID2 has diverged considerably from ARID1A/ARID1B and exists in a unique SWI/SNF assembly known as PBAF (or SWI/SNF-B), which contains several unique subunits not found in ARID1A/B-containing complexes. The composition of SWI/SNF can also be dynamically reconfigured during cell fate transitions through cell type-specific expression patterns of certain subunits. For example, BAF53A/ACTL6A is repressed and replaced by BAF53B/ACTL6B during neuronal differentiation, a switch that is essential for proper neuronal functions in vivo (Lessard et al. (2007) *Neuron* 55:201-215). These studies stress that SWI/SNF in fact represents a collection of multi-subunit complexes whose integrated functions control diverse cellular processes, which is also incorporated in the scope of definitions of the instant disclosure. Two recently published meta-analyses of cancer genome sequencing data estimate that nearly 20% of human cancers harbor mutations in one (or more) of the genes encoding SWI/SNF (Kadoch et al. (2013) *Nat Genet.* 45:592-601; Shain and Pollack (2013) *PLoS One.* 8:e55119). Such mutations are generally loss-of-function, implicating SWI/SNF as a major tumor suppressor in diverse cancers. Specific SWI/SNF gene mutations are generally linked to a specific subset of cancer lineages: SNF5 is mutated in malignant rhabdoid tumors (MRT), PBRM1/BAF180 is frequently inactivated in renal carcinoma, and BRG1 is mutated in non-small cell lung cancer (NSCLC) and several other cancers. In the instant disclosure, the scope of "SWI/SNF complex" may cover at least one fraction or the whole complex (e.g., some or all subunit proteins/other components), either in the human BAF/PBAF forms or their homologs/orthologs in other species (e.g., the yeast and *drosophila* forms described herein). Preferably, a "SWI/SNF complex" described herein contains at least part of the full complex bio-functionality, such as binding to other subunits/componets, binding to DNA/histone, catalyzing ATP, promoting chromotin remodeling, etc.

The term "BAF complex" refers to at least one type of mammalian SWI/SNF complexes. Its nucleosome remodeling activity can be reconstituted with a set of four core subunits (BRG1/SMARCA4, SNF5/SMARCB1, BAF155/SMARCC1, and BAF170/SMARCC2), which have orthologs in the yeast complex (Phelan et al. (1999) *Mol Cell.* 3:247-253). However, mammalian SWI/SNF contains several subunits not found in the yeast counterpart, which can provide interaction surfaces for chromatin (e.g. acetyl-lysine recognition by bromodomains) or transcription factors and thus contribute to the genomic targeting of the complex (Wang et al. (1996) *EMBO J.* 15:5370-5382; Wang et al. (1996) *Genes Dev.* 10:2117-2130; Nie et al. (2000)). A key attribute of mammalian SWI/SNF is the heterogeneity of subunit configurations that can exist in different tissues and even in a single cell type (e.g., as BAF, PBAF, neural progenitor BAF (npBAF), neuron BAF (nBAF), embryonic stem cell BAF (esBAF), etc.). In some embodiments, the BAF complex described herein refers to one type of mammalian SWI/SNF complexes, which is different from PBAF complexes.

The term "PBAF complex" refers to one type of mammalian SWI/SNF complexes originally known as SWI/SNF-B. It is highly related to the BAF complex and can be separated with conventional chromatographic approaches. For example, human BAF and PBAF complexes share multiple identical subunits (such as BRG, BAF170, BAF155, BAF60, BAF57, BAF53, BAF45, actin, SS18, and hSNF5/INI1, as illustrated in FIG. 9). However, while BAF contains BAF250 subunit, PBAF contains BAF180 and BAF200, instead (Lemon et al. (2001) *Nature* 414:924-998; Yan et al. (2005) *Genes Dev.* 19:1662-1667). Moreover, they do have selectivity in regulating interferon-responsive genes (Yan et al. (2005), supra, showing that BAF200, but not BAF180, is required for PBAF to mediate expression of IFI™1 gene induced by IFN-α, while the IFITM3 gene expression is dependent on BAF but not PBAF). Due to these differentces, PBAF, but not BAF, was able to activate vitamin D receptor-dependent transcription on a chromatin-zed template in vitro (Lemon et al. (2001), supra). The 3-D structure of human PBAF complex preserved in negative stain was found to be similar to yeast RSC but dramatically different from yeast SWI/SNF (Leschziner et al. (2005) *Structure* 13:267-275).

The term "BRG" or "BRG1/BAF190 (SMARCA4)" refers to a subunit of the SWI/SNF complex, which can be find in either BAF or PBAF complex. It is an ATP-depedendent helicase and a transcription activator, encoded by the SMARCA4 gene. BRG1 can also bind BRCA1, as well as regulate the expression of the tumorigenic protein CD44. BRG1 is important for development past the pre-implantation stage. Without having a functional BRG1, exhibited with knockout research, the embryo will not hatch out of the zona pellucida, which will inhibit implantation from occurring on the endometrium (uterine wall). BRG1 is also crucial to the development of sperm. During the first stages of meiosis in spermatogenesis there are high levels of BRG1. When BRG1 is genetically damaged, meiosis is stopped in prophase 1, hindering the development of sperm and would result in infertility. More knockout research has concluded BRG1's aid in the development of smooth muscle. In a BRG1 knockout, smooth muscle in the gastrointestinal tract lacks contractility, and intestines are incomplete in some cases. Another defect occurring in knocking out BRG1 in smooth muscle development is heart complications such as an open ductus arteriosus after birth (Kim et al. (2012) *Development* 139:1133-1140; Zhang et al. (2011) *Mol. Cell. Biol.* 31:2618-2631). Mutations in SMARCA4 were first recognized in human lung cancer cell lines (Medina et al. (2008) *Hum. Mut.* 29:617-622). Later it was recognized that mutations exist in a significant frequency of medulloblastoma and pancreatic cancers among other tumor subtypes (Jones et al. (2012) *Nature* 488:100-105; Shain et al. (2012) *Proc Natl Acad Sci USA* 109:E252-E259; Shain and Pollack (2013), supra). Mutations in BRG1 (or SMARCA4) appear to be mutually exclusive with the presence of activation at any of the MYC-genes, which indicates that the BRG1 and MYC proteins are functionally related. Another recent study demonstrated a causal role of BRG1 in the control of retinoic acid and glucocorticoid-induced cell differentiation in lung cancer and in other tumor types. This enables the cancer cell to sustain undifferentiated gene expression programs that affect the control of key cellular processes. Furthermore, it explains why lung cancer and other solid tumors are completely refractory to treatments based on these compounds that are effective therapies for some types of leukemia (Romero et al. (2012) EMBO Mol. Med. 4:603-616). The role of BRG1 in sensitivity or resistance to anti-cancer drugs had been recently highlighted by the elucidation of the mechanisms of action of darinaparsin, an arsenic-based anti-cancer drugs. Darinaparsin has been shown to induce phosphorylation of BRG1, which leads to its exclusion from the chromatin. When excluded from the chromatin, BRG1 can no longer act as a transcriptional co-regulator. This leads to the inability of cells to express HO-1, a cytoprotective enzyme. BRG1 has been shown to interact with proteins such as ACTL6A, ARID1A, ARID1B, BRCA1, CTNNB1, CBXS, CREBBP, CCNE1, ESR1, FANCA, HSP90B1, ING1, Myc, NR3C1, P53, POLR2A, PHB, SIN3A, SMARCB1, SMARCC1, SMARCC2, SMARCE1, STAT2, STK11, etc.

The term "BRG" or "BRG1/BAF190 (SMARCA4)" is intended to include fragments, variants (e.g., allelic variants), and derivatives thereof. Representative human BRG1 (SMARCA4) cDNA and human BRG1 protein sequences are well-known in the art and are publicly available from the National Center for Biotechnology Information (NCBI). For example, seven different human BRG1 isoforms are known. Human BRG1 isoform A (NP_001122321.1) is encodable by the transcript variant 1 (NM_001128849.1), which is the longest transcript. Human BRG1 isoform B (NP_001122316.1 or NP_003063.2) is encodable by the transcript variant 2 (NM_001128844.1), which differs in the 5' UTR and lacks an alternate exon in the 3' coding region, compared to the variant 1, and also by the transcript variant 3 (NM_003072.3), which lacks an alternate exon in the 3' coding region compared to variant 1. Human BRG1 isoform C (NP_001122317.1) is encodable by the transcript variant 4 (NM_001128845.1), which lacks two alternate in-frame exons and uses an alternate splice site in the 3' coding region, compared to variant 1. Human BRG1 isoform D (NP_001122318.1) is encodable by the transcript variant 5 (NM_001128846.1), which lacks two alternate in-frame exons and uses two alternate splice sites in the 3' coding region, compared to variant 1. Human BRG1 isoform E (NP_001122319.1) is encodable by the transcript variant 6 (NM_001128847.1), which lacks two alternate in-frame exons in the 3' coding region, compared to variant 1. Human BRG1 isoform F (NP_001122320.1) is encodable by the transcript variant 7 (NM_001128848.1), which lacks two alternate in-frame exons and uses an alternate splice site in the 3' coding region, compared to variant 1. Nucleic acid and polypeptide sequences of BRG1 orthologs in organisms other than humans are well known and include, for example, chimpanzee BRG1 (XM_016935029.1 and XP 016790518.1, XM_016935038.1 and XP_016790527.1, XM_016935039.1 and XP_016790528.1, XM_016935036.1 and XP_016790525.1, XM_016935037.1 and XP_016790526.1, XM_016935041.1 and XP_016790530.1, XM_016935040.1 and XP_016790529.1, XM_016935042.1 and XP_016790531.1, XM_016935043.1 and XP_016790532.1, XM_016935035.1 and XP_016790524.1, XM_016935032.1 and XP_016790521.1, XM_016935033.1 and XP_016790522.1, XM_016935030.1 and XP_016790519.1, XM_016935031.1 and XP_016790520.1, and XM_016935034.1 and XP_016790523.1), Rhesus monkey BRG1 (XM_015122901.1 and XP_014978387.1, XM_015122902.1 and XP_014978388.1, XM_015122903.1 and XP_014978389.1, XM_015122906.1 and XP_014978392.1, XM_015122905.1 and XP_014978391.1, XM_015122904.1 and XP_014978390.1, XM_015122907.1 and XP_014978393.1, XM_015122909.1 and XP_014978395.1, and XM_015122910.1 and XP_014978396.1), dog BRG1 (XM_014122046.1 and) XP_013977521.1, XM_014122043.1 and XP_013977518.1, XM_014122042.1 and) XP_013977517.1, XM_014122041.1 and XP_013977516.1, XM_014122045.1 and XP_013977520.1, and XM_014122044.1 and XP_013977519.1), cattle BRG1 (NM_001105614.1 and NP_001099084.1), mouse BRG1 (NM_001174078.1 and NP_001167549.1, NM_001174079.1 and NP_001167550.1, and NM_011417.3 and NP_035547.2), rat BRG1 (NM_134368.1 and NP_599195.1), chicken BRG1 (NM_205059.1 and NP_990390.1), and zebrafish BRG1 (NM_181603.1 and NP_853634.1).

Anti-BRG1 antibodies suitable for detecting BRG1 protein are well-known in the art and include, for example, MABE1118, MABE121, MABE60, and 07-478 (poly- and mono-clonal antibodies from EMD Millipore, Billerica, Mass.), AM26021PU-N, AP23972PU-N, TA322909, TA322910, TA327280, TA347049, TA347050, TA347851, and TA349038 (antibodies from OriGene Technologies, Rockville, Md.), NB100-2594, AF5738, NBP2-22234, NBP2-41270, NBP1-51230, and NBP1-40379 (antibodes from Novus Biologicals, Littleton, Colo.), ab110641, ab4081, ab215998, ab108318, ab70558, ab118558, ab133257, ab92496, ab196535, and ab196315 (antibodies from AbCam, Cambridge, Mass.), Cat #: 720129, 730011, 730051, MA1-10062, PAS-17003, and PAS-17008 (antibodies from ThermoFisher Scientific, Waltham, Mass.), GTX633391, GTX32478, GTX31917, GTX16472, and GTX50842 (antibodies from GeneTex, Irvine, Calif.), antibody 7749 (ProSci, Poway, Calif.), Brg-1 (N-15), Brg-1 (N-15) X, Brg-1 (H-88), Brg-1 (H-88) X, Brg-1 (P-18), Brg-1 (P-18) X, Brg-1 (G-7), Brg-1 (G-7) X, Brg-1 (H-10), and Brg-1 (H-10) X (antibodies from Santa Cruz Biotechnology, Dallas, Tex.), antibody of Cat. AF5738 (R&D Systmes, Minneapolis, Minn.), etc. In addition, reagents are well-known for detecting BRG1 expression. Moreover, mutilple siRNA, shRNA, CRISPR constructs for reducing BRG1 Expression can be found in the commercial product lists of the above-referenced companies. PFI 3 is a known small molecule inhibitor of polybromo 1 and BRG1 (e.g., Cat. B7744 from APExBIO, Houston, Tex.). It is to be noted that the term can further be used to refer to any combination of features described herein regarding BRG1 molecules. For example, any combination of sequence composition, percentage identify, sequence length, domain structure, functional activity, etc. can be used to describe an BRG1 molecule of the present invention.

The term "BRM" or "BRM/BAF190 (SMARCA2)" refers to a subunit of the SWI/SNF complex, which can be found in either BAF or PBAF complexes. It is an ATP-depedendent helicase and a transcription activator, encoded by the SMARCA2 gene. The catalytic core of the SWI/SNF complex can be either of two closely related ATPases, BRM or BRG1, with the potential that the choice of alternative subunits is a key determinant of specificity. Instead of impeding differentiation as was seen with BRG1 depletion, depletion of BRM caused accelerated progression to the differentiation phenotype. BRM was found to regulate genes different from those as BRG1 targets and be capable of overriding BRG1-dependent activation of the osteocalcin promoter, due to its interaction with different ARID family members (Flowers et al. (2009), supra). The known binding partners for BRM include, for example, ACTL6A, ARID1B, CEBPB, POLR2A, Prohibitin, SIN3A, SMARCB1, and SMARCC1.

The term "BRM" or "BRM/BAF190 (SMARCA2)" is intended to include fragments, variants (e.g., allelic variants), and derivatives thereof. Representative human BRM (SMARCA2) cDNA and human BRM protein sequences are well-known in the art and are publicly available from the National Center for Biotechnology Information (NCBI). For example, seven different human BRM isoforms are known. Human BRM isoform A (NP_003061.3 or NP_001276325.1) is encodable by the transcript variant 1 (NM_003070.4), which is the longest transcript, or the transcript variant 3 (NM_001289396.1), which differs in the 5' UTR, compared to variant 1. Human BRM isoform B (NP_620614.2) is encodable by the transcript variant 2 (NM_139045.3), which lacks an alternate in-frame exon in the coding region, compared to variant 1. Human BRM isoform C (NP_001276326.1) is encodable by the transcript variant 4 (NM_001289397.1), which uses an alternate in-frame splice site and lacks an alternate in-frame exon in the 3' coding region, compared to variant 1. Human BRM isoform D (NP_001276327.1) is encodable by the transcript variant 5 (NM_001289398.1), which differs in the 5' UTR, lacks a portion of the 5' coding region, and initiates translation at an alternate downstream start codon, compared to variant 1. Human BRM isoform E (NP_001276328.1) is encodable by the transcript variant 6 (NM_001289399.1), which differs in the 5' UTR, lacks a portion of the 5' coding region, and initiates translation at an alternate downstream start codon, compared to variant 1. Human BRM isoform F (NP_001276329.1) is encodable by the transcript variant 7 (NM_001289400.1), which differs in the 5' UTR, lacks a portion of the 5' coding region, and initiates translation at an alternate downstream start codon, compared to variant 1. Nucleic acid and polypeptide sequences of BRM orthologs in organisms other than humans are well known and include, for example, chimpanzee BRM (XM_016960529.1 and XP_016816018.1), dog BRG1 (XM_005615906.2 and XP_005615963.1, XM_845066.4 and XP_850159.1, XM_005615905.2 and XP_005615962.1, XM_005615904.2 and XP_005615961.1, XM_005615903.2 and XP_005615960.1, and XM_005615902.2 and XP_005615959.1), cattle BRM (NM_001099115.2 and NP_001092585.1), mouse BRM (NM_001347439.1 and NP_001334368.1, NM_011416.2 and NP_035546.2, and NM_026003.2 and NP_080279.1), rat BRM (NM_001004446.1 and NP_001004446.1), chicken BRM (NM_205139.1 and NP_990470.1), tropical clawed frog BRM (XM_012952601.1 and XP_012808055.1, XM_012952608.2 and XP_012808062.1, XM_012952597.2 and XP_012808051.1, XM_012952613.2 and XP_012808067.1, and XM_002941009.4 and XP_002941055.2), and zebrafish BRM (NM_001044775.2 and NP_001038240.1).

Anti-BRM antibodies suitable for detecting BRM protein are well-known in the art and include, for example, antibody MABE89 (EMD Millipore, Billerica, Mass.), antibody TA351725 (OriGene Technologies, Rockville, Md.), NBP1-90015, NBP1-80042, NB100-55308, NB100-55309, NB100-55307, and H00006595-M06 (antibodes from Novus Biologicals, Littleton, Colo.), ab15597, ab12165, ab58188, and ab200480 (antibodies from AbCam, Cambridge, Mass.), Cat #: 11966 and 6889 (antibodies from Cell Signaling, Danvers, Mass.), etc. In addition, reagents are well-known for detecting BRM expression. Moreover, mutilple siRNA, shRNA, CRISPR constructs for reducing BRM Expression can be found in the commercial product lists of the above-referenced companies. For example, BRM RNAi product H00006595-R02 (Novus Biologicals), CRISPER gRNA products from GenScript, Piscataway, N.J., and other inhibitory RNA products from Origene, ViGene Biosciences (Rockville, Md.), and Santa Cruz. It is to be noted that the term can further be used to refer to any combination of features described herein regarding BRM molecules. For example, any combination of sequence composition, percentage identify, sequence length, domain structure, functional activity, etc. can be used to describe an BRM molecule of the present invention.

The term "BAF200" or "ARID2" refers to AT-rich interactive domain-containing protein 2, a subunit of the SWI/SNF complex, which can be found in PBAF but not BAF complexes. It facilitates ligand-dependent transcriptional activation by nuclear receptors. The ARID2 gene, located on chromosome 12q in humans, consists of 21 exons; orthologs are known from mouse, rat, cattle, chicken, and mosquito (Zhao et al. (2011) *Oncotarget* 2:886-891). A conditional knockout mouse line, called Arid2$^{tm1a(EUCOMM)Wtsi}$ was generated as part of the International Knockout Mouse Consortium program, a high-throughput mutagenesis project to generate and distribute animal models of disease (Skames et al. (2011) *Nature* 474:337-342). Human ARID2 protein has 1835 amino acids and a molecular mass of 197391 Da. The ARID2 protein contains two conserved C-terminal C2H2 zinc fingers motifs, a region rich in the amino acid residues proline and glutamine, a RFX (regulatory factor X)-type winged-helix DNA-binding domain (e.g., amino acids 521-601 of SEQ ID NO:8), and a conserved N-terminal AT-rich DNA interaction domain (e.g., amino acids 19-101 of SEQ ID NO:8; Zhao et al. (2011), supra). Mutation studies have revealed ARID2 to be a significant tumor suppressor in many cancer subtypes. ARID2 mutations are prevalent in hepatocellular carcinoma (Li et al. (2011) *Nature Genetics*. 43:828-829) and melanoma (Hodis et al. (2012) *Cell* 150: 251-263; Krauthammer et al. (2012) *Nature Genetics*. 44:1006-1014). Mutations are present in a smaller but significant fraction in a wide range of other tumors (Shain and Pollack (2013), supra). ARID2 mutations are enriched in hepatitis C virus-associated hepatocellular carcinoma in the U.S. and European patient populations compared with the overall mutation frequency (Zhao et al. (2011), supra). The known binding partners for ARID2 include, e.g., Serum Response Factor (SRF) and SRF cofactors MYOCD, NKX2-5 and SRFBP1.

The term "BAF200" or "ARID2" is intended to include fragments, variants (e.g., allelic variants), and derivatives thereof. ReRepresentative human ARID2 cDNA and human ARID2 protein sequences are well-known in the art and are publicly available from the National Center for Biotechnology Information (NCBI). For example, two different human ARID2 isoforms are known. Human ARID2 isoform A (NP_689854.2) is encodable by the transcript variant 1 (NM_152641.3), which is the longer transcript. Human ARID2 isoform B (NP_001334768.1) is encodable by the transcript variant 2 (NM_001347839.1), which differs in the 3' UTR and 3' coding region compared to isoform A. The encoded isoform B has a shorter C-terminus compared to isoform A. Nucleic acid and polypeptide sequences of ARID2 orthologs in organisms other than humans are well known and include, for example, chimpanzee ARID2 (XM_016923581.1 and XP_016779070.1, and XM_016923580.1 and XP_016779069.1), Rhesus monkey ARID2 (XM_015151522.1 and XP_015007008.1), dog ARID2 (XM_003433553.2 and XP_003433601.2; and XM_014108583.1 and XP_013964058.1), cattle ARID2 (XM_002687323.5 and XP_002687369.1; and XM_015463314.1 and XP_015318800.1), mouse ARID2 (NM_175251.4 and NP_780460.3), rat ARID2 (XM_345867.8 and XP_345868.4; and XM_008776620.1 and XP_008774842.1), chicken ARID2 (XM_004937552.2 and XP_004937609.1, XM_004937551.2 and XP_004937608.1, XM_004937554.2 and XP_004937611.1, and XM_416046.5 and XP_416046.2), tropical clawed frog ARID2 (XM_002932805.4 and XP_002932851.1, XM_018092278.1 and) XP_017947767.1, and XM_018092279.1 and XP_017947768.1), and zebrafish ARID2 (NM_001077763.1 and NP_001071231.1, and XM_005164457.3 and XP_005164514.1). ReRepresentative sequences of ARID2 orthologs are presented below in Table 1.

Anti-ARID2 antibodies suitable for detecting ARID2 protein are well-known in the art and include, for example, antibodies ABE316 and 04-080 (EMD Millipore, Billerica, Mass.), antibodies NBP1-26615, NBP2-43567, and NBP1-26614 (Novus Biologicals, Littleton, Colo.), antibodies ab51019, ab166850, ab113283, and ab56082 (AbCam, Cambridge, Mass.), antibodies Cat #: PAS-35857 and PAS-51258 (ThermoFisher Scinetific, Waltham, Mass.), antibodies GTX129444, GTX129443, and GTX632011 (GeneTex, Irvine, Calif.), ARID2 (H-182) Antibody, ARID2 (H-182) X Antibody, ARID2 (S-13) Antibody, ARID2 (S-13) X Antibody, ARID2 (E-3) Antibody, and ARID2 (E-3) X Antibody (Santa Cruz Biotechnology), etc. In addition, reagents are well-known for detecting ARID2 expression. Multiple clinical tests of PBRM1 are available in NIH Genetic Testing Registry (GTR®) (e.g., GTR Test ID: GTR000541481.2, offered by Fulgent Clinical Diagnostics Lab (Temple City, Calif.)). Moreover, mutilple siRNA, shRNA, CRISPR constructs for reducing ARID2 expression can be found in the commercial product lists of the above-referenced companies, such as siRNA product #SR316272, shRNA products #TR306601, TR505226, TG306601, SR420583, and CRISPER products #KN212320 and KN30154 from Origene Technologies (Rockville, Md.), RNAi product H00196528-R01 (Novus Biologicals), CRISPER gRNA products from GenScript (Cat. # KN301549 and KN212320, Piscataway, N.J.) and from Santa Cruz (sc-401863), and RNAi products from Santa Cruz (Cat # sc-96225 and sc-77400). It is to be noted that the term can further be used to refer to any combination of features described herein regarding ARID2 molecules. For example, any combination of sequence composition, percentage identify, sequence length, domain structure, functional activity, etc. can be used to describe an ARID2 molecule of the present invention.

The term "loss-of-function mutation" for BAF200/ARID2 refers to any mutation in a ARID2-related nucleic acid or protein that results in reduced or eliminated ARID2 protein amounts and/or function. For example, nucleic acid mutations include single-base substitutions, multi-base substitutions, insertion mutations, deletion mutations, frame-shift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID2. Such mutations reduce or eliminate ARID2 protein amounts and/or function by eliminating proper coding sequences required for proper ARID2 protein translation and/or coding for ARID2 proteins that are non-functional or have reduced function (e.g., deletion of enzymatic and/or structural domains, reduction in protein stability, alteration of subcellular localization, and the like). Such mutations are well-known in the art. In addition, a reRepresentative list describing a wide variety of structural mutations correlated with the functional result of reduced or eliminated ARID2 protein amounts and/or function is described in the Tables and the Examples.

The term "BRD7" refers to Bromodomain-containing protein 7, a subunit of the SWI/SNF complex, which can be found in PBAF but not BAF complexes. BRD7 is a transcriptional corepressor that binds to target promoters (e.g., the ESR1 promoter) and down-regulates the expression of target genes, leading to increased histone H3 acetylation at Lys-9 (H3K9ac). BRD7 can recruit other proteins such as BRCA1 and POU2F1 to, e.g., the ESR1 promoter for its function. BRD7 activates the Wnt signaling pathway in a DVL1-dependent manner by negatively regulating the GSK3B phosphotransferase activity, while BRD7 induces dephosphorylation of GSK3B at Tyr-216. BRD7 is also a coactivator for TP53-mediated activation of gene transcription and is required for TP53-mediated cell-cycle arrest in response to oncogene activation. BRD7 promotes acetylation of TP53 at Lys-382, and thereby promotes efficient recruitment of TP53 to target promoters. BRD7 also inhibits cell cycle progression from G1 to S phase. For studies on BRD7 functions, see Zhou et al. (2006) *J. Cell. Biochem.* 98:920-930; Harte et al. (2010) *Cancer Res.* 70:2538-2547; Drost et al. (2010) *Nat. Cell Biol.* 12:380-389. The known binding partners for BRD7 aslo include, e.g., Tripartite Motif Containing 24 (TRIM24), Protein Tyrosine Phosphatase, Non-Receptor Type 13 (PTPN13), Dishevelled Segment Polarity Protein 1 (DVL1), interferon regulatory factor 2 (IRF2) (Staal et al. (2000) *J. Cell. Physiol.* US 185:269-279) and heterogeneous nuclear ribonucleoprotein U-like protein 1 (HNRPUL1) (Kzhyshkowska et al. (2003) *Biochem. J.* England. 371:385-393). Human BRD7 protein has 651 amino acids and a molecular mass of 74139 Da, with a N-terminal nuclear localization signal (e.g., amino acids 65-96 of SEQ ID NO:14), a Bromo-BRD7-like domain (e.g., amino acids 135-232 of SEQ ID NO:14), and a DUF3512 domain (e.g., amino acids 287-533 of SEQ ID NO:14).

The term "BRD7" is intended to include fragments, variants (e.g., allelic variants), and derivatives thereof. ReRepresentative human BRD7 cDNA and human BRD7 protein sequences are well-known in the art and are publicly available from the National Center for Biotechnology Information (NCBI). For example, two different human BRD7 isoforms are known. Human BRD7 isoform A (NP_001167455.1) is encodable by the transcript variant 1 (NM_001173984.2), which is the longer transcript. Human BRD7 isoform B (NP_037395.2) is encodable by the transcript variant 2 (NM_013263.4), which uses an alternate in-frame splice site in the 3' coding region, compared to variant 1. The resulting isoform B lacks one internal residue, compared to isoform A. Nucleic acid and polypeptide sequences of BRD7 orthologs in organisms other than humans are well known and include, for example, chimpanzee BRD7 (XM_009430766.2 and XP_009429041.1, XM_016929816.1 and XP_016785305.1, XM_016929815.1 and XP_016785304.1, and XM_003315094.4 and XP_003315142.1), Rhesus monkey BRD7 (XM_015126104.1 and) CP 014981590.1, XM_015126103.1 and XP_014981589.1, XM_001083389.3 and XP_001083389.2, and XM_015126105.1 and XP_014981591.1), dog BRD7 (XM_014106954.1 and XP_013962429.1), cattle BRD7 (NM_001103260.2 and NP_001096730.1), mouse BRD7 (NM_012047.2 and NP_036177.1), chicken BRD7 (NM_001005839.1 and NP_001005839.1), tropical clawed frog BRD7 (NM_001008007.1 and NP_001008008.1), and zebrafish BRD7 (NM_213366.2 and NP_998531.2). Representative sequences of BRD7 orthologs are presented below in Table 1.

Anti-BRD7 antibodies suitable for detecting BRD7 protein are well-known in the art and include, for example, antibody TA343710 (Origene), antibody NBP1-28727 (Novus Biologicals, Littleton, Colo.), antibodies ab56036, ab46553, ab202324, and ab114061 (AbCam, Cambridge, Mass.), antibodies Cat #: 15125 and 14910 (Cell Signaling), antibody GTX118755 (GeneTex, Irvine, Calif.), BRD7 (P-13) Antibody, BRD7 (T-12) Antibody, BRD7 (H-77) Antibody, BRD7 (H-2) Antibody, and BRD7 (B-8) Antibody (Santa Cruz Biotechnology), etc. In addition, reagents are well-known for detecting BRD7 expression. A clinical test of BRD7 is available in NIH Genetic Testing Registry (GTR®) with GTR Test ID: GTR000540400.2, offered by Fulgent Clinical Diagnostics Lab (Temple City, Calif.)). Moreover, mutilple siRNA, shRNA, CRISPR constructs for reducing BRD7 expression can be found in the commercial product lists of the above-referenced companies, such as shRNA product #TR100001 and CRISPER products # KN302255 and KN208734 from Origene Technologies (Rockville, Md.), RNAi product H00029117-R01 (Novus Biologicals), and small molecule inhibitors BI 9564 and TP472 (Tocris Bioscience, UK). It is to be noted that the term can further be used to refer to any combination of features described herein regarding BRD7 molecules. For example, any combination of sequence composition, percentage identify, sequence length, domain structure, functional activity, etc. can be used to describe an BRD7 molecule of the present invention.

The term "loss-of-function mutation" for BRD7 refers to any mutation in a BRD7-related nucleic acid or protein that results in reduced or eliminated BRD7 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of BRD7. Such mutations reduce or eliminate BRD7 protein amounts and/or function by eliminating proper coding sequences required for proper BRD7 protein translation and/or coding for BRD7 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated BRD7 protein amounts and/or function is described in the Tables and the Examples.

The term "BAF45A" or "PHF10" refers to PHD finger protein 10, a subunit of the PBAF complex having two zinc finger domains at its C-terminus. PHF10 belongs to the neural progenitors-specific chromatin remodeling complex (npBAF complex) and is required for the proliferation of neural progenitors. During neural development a switch from a stem/progenitor to a post-mitotic chromatin remodeling mechanism occurs as neurons exit the cell cycle and become committed to their adult state. The transition from proliferating neural stem/progenitor cells to post-mitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. PHF10 gene encodes at least two types of evolutionarily conserved, ubiquitously expressed isoforms that are incorporated into the PBAF complex in a mutually exclusive manner. One isoform contains C-terminal tandem PHD fingers, which in the other isoform are replaced by the consensus sequence for phosphorylation-dependent SUMO 1 conjugation (PDSM) (Brechalov et al. (2014) Cell Cycle 13:1970-1979). PBAF complexes containing different PHF10 isoforms can bind to the promoters of the same genes but produce different effects on the recruitment of Pol II to the promoter and on the level of gene transcription. PHF10 is a transcriptional repressor of caspase 3 and impares the programmed cell death pathway in human gastric cancer at the transcriptional level (Wei et al. (2010) *Mol Cancer Ther.* 9:1764-1774). Knockdown of PHF10 expression in gastric cancer cells led to significant induction of caspase-3 expression at both the RNA and protein levels and thus induced alteration of caspase-3 substrates in a time-dependent manner (Wei et al. (2010), supra). Results from luciferase assays by the same group indicated that PHF10 acted as a transcriptional repressor when the two PHD domains contained in PHF10 were intact. Human PHF10 protein has 498 amino acids and a molecular mass of 56051 Da, with two domains essential to induce neural progenitor proliferation (e.g., amino acids 89-185 and 292-334 of SEQ ID NO:20) and two PHD finger domains (e.g., amino acids 379-433 and 435-478 of SEQ ID NO:20). By similarity, PHF10 binds to ACTL6A/BAF53A, SMARCA2/BRM/BAF190B, SMARCA4/BRG1/BAF190A and PBRM1/BAF180.

The term "BAF45A" or "PHF10" is intended to include fragments, variants (e.g., allelic variants), and derivatives thereof. ReRepresentative human PHF10 cDNA and human PHF10 protein sequences are well-known in the art and are publicly available from the National Center for Biotechnology Information (NCBI). For example, two different human PHF10 isoforms are known. Human PHF10 isoform A (NP_060758.2) is encodable by the transcript variant 1 (NM_018288.3), which is the longer transcript. Human PHF10 isoform B (NP_579866.2) is encodable by the transcript variant 2 (NM_133325.2), which uses an alternate splice junction which results in six fewer nt when compared to variant 1. The isoform B lacks 2 internal amino acids compared to isoform A. Nucleic acid and polypeptide sequences of PHF10 orthologs in organisms other than humans are well known and include, for example, chimpanzee PHF10 (XM_016956680.1 and XP_016812169.1, XM_016956679.1 and XP_016812168.1, and XM_016956681.1 and XP_016812170.1), Rhesus monkey PHF10 (XM_015137735.1 and XP_014993221.1, and XM_015137734.1 and XP_014993220.1), dog PHF10 (XM_005627727.2 and XP_005627784.1, XM_005627726.2 and XP_005627783.1, XM_532272.5 and XP_532272.4, XM_014118230.1 and XP_013973705.1, and XM_014118231.1 and XP_013973706.1), cattle PHF10 (NM_001038052.1 and NP_001033141.1), mouse PHF10 (NM_024250.4 and NP_077212.3), rat PHF10 (NM_001024747.2 and NP_001019918.2), chicken PHF10 (XM_015284374.1 and XP_015139860.1), tropical clawed frog PHF10 (NM_001030472.1 and NP_001025643.1), zebrafish PHF10 (NM_200655.3 and NP_956949.3), and C. elegans PHF10 (NM_001047648.2 and NP_001041113.1, NM_001047647.2 and NP_001041112.1, and NM_001313168.1 and NP_001300097.1). Representative sequences of PHF10 orthologs are presented below in Table 1.

Anti-PHF10 antibodies suitable for detecting PHF10 protein are well-known in the art and include, for example, antibody TA346797 (Origene), antibodies NBP1-52879, NBP2-19795, NBP2-33759, and H00055274-B01P (Novus Biologicals, Littleton, Colo.), antibodies ab154637, ab80939, and ab68114 (AbCam, Cambridge, Mass.), antibody Cat # PAS-30678 (ThermoFisher Scientific), antibody Cat #26-352 (ProSci, Poway, Calif.), etc. In addition, reagents are well-known for detecting PHF10 expression. A clinical test of PHF10 for hereditary disese is available with the test ID no. GTR000536577 in NIH Genetic Testing Registry (GTR®), offered by Fulgent Clinical Diagnostics Lab (Temple City, Calif.). Moreover, mutilple siRNA, shRNA, CRISPR constructs for reducing PHF10 expression can be found in the commercial product lists of the above-referenced companies, such as siRNA product #sc-95343 and sc-152206 and CRISPER products # sc-410593 from Santa Cruz Biotechnology, RNAi products H00055274-R01 and H00055274-R02 (Novus Biologicals), and multiple CRISPER products from GenScript (Piscataway, N.J.). Human PHF10 knockout cell (from HAP1 cell line) is also available from Horizon Discovery (Cat # HZGHC002778c011, UK). It is to be noted that the term can further be used to refer to any combination of features described herein regarding PHF10 molecules. For example, any combination of sequence composition, percentage identify, sequence length, domain structure, functional activity, etc. can be used to describe an PHF10 molecule of the present invention.

The term "loss-of-function mutation" for BAF45A/PHF10 refers to any mutation in a PHF10-related nucleic acid or protein that results in reduced or eliminated PHF10 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of PHF10. Such mutations reduce or eliminate PHF10 protein amounts and/or function by eliminating proper coding sequences required for proper PHF10 protein translation and/or coding for PHF10 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated PHF10 protein amounts and/or function is described in the Tables and the Examples.

The term "PBRM1" or "BAF180" refers to protein Polybromo-1, which is a subunit of ATP-dependent chromatin-remodeling complexes. PBRM1 functions in the regulation of gene expression as a constituent of the evolutionary-conserved SWI/SNF chromatin remodelling complexes (Euskirchen et al. (2012) J. Biol. Chem. 287:30897-30905). Beside BRD7 and BAF200, PBRM1 is one of the unique components of the SWI/SNF-B complex, also known as polybromo/BRG1-associated factors (or PBAF), absent in the SWI/SNF-A (BAF) complex (Xue et al. (2000) Proc Natl Acad Sci USA. 97:13015-13020; Brownlee et al. (2012) Biochem Soc Trans. 40:364-369). On that account, and because it contains bromodomains known to mediate binding to acetylated histones, PBRM1 has been postulated to target PBAF complex to specific chromatin sites, therefore providing the functional selectivity for the complex (Xue et al. (2000), supra; Lemon et al. (2001) Nature 414:924-928; Brownlee et al. (2012), supra). Although direct evidence for PBRM1 involvement is lacking, SWI/SNF complexes have also been shown to play a role in DNA damage response (Park et al. (2006) EMBO J. 25:3986-3997). In vivo studies have shown that PBRM1 deletion leads to embryonic lethality in mice, where PBRM1 is required for mammalian cardiac chamber maturation and coronary vessel formation (Wang et al. (2004) Genes Dev. 18:3106-3116; Huang et al. (2008) Dev Biol. 319:258-266). PBRM1 mutations are most predominant in renal cell carcinomas (RCCs) and have been detected in over 40% of cases, placing PBRM1 second (after VHL) on the list of most frequently mutated genes in this cancer (Varela et al. (2011) Nature 469:539-542; Hakimi et al. (2013) Eur Urol. 63:848-854; Pena-Llopis et al. (2012) Nat Genet. 44:751-759; Pawlowski et al. (2013) Int J Cancer. 132:E11-E17). PBRM1 mutations have also been found in a smaller group of breast and pancreatic cancers (Xia et al. (2008) Cancer Res. 68:1667-1674; Shain et al. (2012) Proc Natl Acad Sci USA. 109:E252-E259; Numata et al. (2013) Int J Oncol. 42:403-410). PBRM1 mutations are more common in patients with advance stages (Hakimi et al. (2013), supra) and loss of PBRM1 protein expression has been associated with advanced tumour stage, low differentiation grade and worse patient outcome (Pawlowski et al. (2013), supra). In another study, no correlation between PBRM1 status and tumour grade was found (Pena-Llopis et al. (2012), supra). Although PBRM1-mutant tumours are associated with better prognosis than BAP1-mutant tumours, tumours mutated for both PBRM1 and BAP1 exhibit the greatest aggressiveness (Kapur et al. (2013) Lancet Oncol. 14:159-167). PBRM1 is ubiquitously expressed during mouse embryonic development (Wang et al. (2004), supra) and has been detected in various human tissues including pancreas, kidney, skeletal muscle, liver, lung, placenta, brain, heart, intestine, ovaries, testis, prostate, thymus and spleen (Xue et al. (2000), supra; Horikawa and Barrett (2002) DNA Seq. 13:211-215).

PBRM1 protein localises to the nucleus of cells (Nicolas and Goodwin (1996) Gene 175:233-240). As a component of the PBAF chromatin-remodelling complex, it associates with chromatin (Thompson (2009) Biochimie. 91:309-319), and has been reported to confer the localisation of PBAF complex to the kinetochores of mitotic chromosomes (Xue et al. (2000), supra). Human PBRM1 gene encodes a 1582 amino acid protein, also referred to as BAF180. Six bromodomains (BD1-6), known to recognize acetylated lysine residues and frequently found in chromatin-associated proteins, constitute the N-terminal half of PBRM1 (e.g., six BD domains at amino acid residue no. 44-156, 182-284, 383-484, 519-622, 658-762, and 775-882 of SEQ ID NO:2). The C-terminal half of PBRM1 contains two bromo-adjacent homology (BAH) domains (BAH1 and BAH2, e.g., at amino acid residue no. 957-1049 and 1130-1248 of SE ID NO:2), present in some proteins involved in transcription regulation. High mobility group (HMG) domain is located close to the C-terminus of PBRM1 (e.g., amino acid residue no. 1328-1377 of SEQ ID NO:2). HMG domains are found in a number of factors regulating DNA-dependent processes where HMG domains often mediate interactions with DNA.

The term "PBRM1" is intended to include fragments, variants (e.g., allelic variants), and derivatives thereof. ReRepresentative human PBRM1 cDNA and human PBRM1 protein sequences are well-known in the art and are publicly available from the National Center for Biotechnology Information (NCBI). For example, two different human PBRM1 isoforms are known. Human PBRM1 transcript variant 2 (NM_181042.4) represents the longest transcript. Human PBRM1 transcript variant 1 (NM_018313.4, having a CDS from the 115-4863 nucleotide residue of SEQ ID NO:1) differs in the 5' UTR and uses an alternate exon and splice site in the 3' coding region, thus encoding a distinct protein sequence (NP_060783.3, as SEQ ID NO:2) of the same length as the isoform (NP_851385.1) encoded by variant 2. Nucleic acid and polypeptide sequences of PBRM1 orthologs in organisms other than humans are well known and include, for example, chimpanzee PBRM1 (XM_009445611.2 and XP_009443886.1, XM_009445608.2 and XP_009443883.1, XM_009445602.2 and XP_009443877.1, XM_016941258.1 and XP_016796747.1, XM_016941256.1 and XP_016796745.1, XM_016941249.1 and XP_016796738.1, XM_016941260.1 and XP_016796749.1, XM_016941253.1 and XP_016796742.1, XM_016941250.1 and XP_016796739.1, XM_016941261.1 and XP_016796750.1, XM_009445605.2 and XP_009443880.1, XM_016941252.1 and XP_016796741.1, XM_009445603.2 and XP_009443878.1, XM_016941263.1 and XP_016796752.1, XM_016941262.1 and XP_016796751.1, XM_009445604.2 and XP_009443879.1, XM_016941251.1 and XP_016796740.1, XM_016941257.1 and XP_016796746.1, XM_016941255.1 and XP_016796744.1, XM_016941254.1 and XP_016796743.1, XM_016941265.1 and XP_016796754.1, XM_016941264.1 and XP_016796753.1, XM_016941248.1 and XP_016796737.1, XM_009445617.2 and XP_009443892.1, XM_009445616.2 and XP_009443891.1, XM_009445619.2 and XP_009443894.1 XM_009445615.2 and XP_009443890.1, XM_009445618.2 and XP_009443893.1, and XM_016941266.1 and XP_016796755.1), rhesus monkey PBRM1 (XM_015130736.1 and XP_014986222.1, XM_015130739.1 and) XP_014986225.1, XM_015130737.1 and XP_014986223.1, XM_015130740.1 and XP_014986226.1, XM_015130727.1 and XP_014986213.1, XM_015130726.1 and XP_014986212.1, XM_015130728.1 and XP_014986214.1, XM_015130743.1 and) CP 014986229.1, XM_015130731.1 and XP_014986217.1, XM_015130745.1 and XP_014986231.1, XM_015130741.1 and XP_014986227.1, XM_015130734.1 and XP_014986220.1, XM_015130744.1 and XP_014986230.1, XM_015130748.1 and XP_014986234.1, XM_015130746.1 and XP_014986232.1, XM_015130742.1 and XP_014986228.1, XM_015130747.1 and XP_014986233.1, XM_015130730.1 and XP_014986216.1, XM_015130732.1 and XP_014986218.1, XM_015130733.1 and XP_014986219.1, XM_015130735.1 and XP_014986221.1, XM_015130738.1 and) XP_014986224.1, and XM_015130725.1 and XP_014986211.1), dog PBRM1 (XM_005632441.2 and XP_005632498.1, XM_014121868.1 and XP_013977343.1, XM_005632451.2 and XP_005632508.1, XM_014121867.1 and XP_013977342.1, XM_005632440.2 and XP_005632497.1, XM_005632446.2 and XP_005632503.1, XM_533797.5 and XP_533797.4, XM_005632442.2 and XP_005632499.1, XM_005632439.2 and XP_005632496.1, XM_014121869.1 and XP_013977344.1, XM_005632448.1 and XP_005632505.1, XM_005632449.1 and XP_005632506.1, XM_005632452.1 and XP_005632509.1, XM_005632445.1 and XP_005632502.1, XM_005632450.1 and XP_005632507.1, XM_005632453.1 and XP_005632510.1, XM_014121870.1 and XP_013977345.1, XM_005632443.1 and XP_005632500.1, XM_005632444.1 and XP_005632501.1, and XM_005632447.2 and XP_005632504.1), cow PBRM1 (XM_005222983.3 and XP_005223040.1, XM_005222979.3 and XP_005223036.1, XM_015459550.1 and XP_015315036.1, XM_015459551.1 and XP_015315037.1, XM_015459548.1 and XP_015315034.1, XM_010817826.1 and XP_010816128.1, XM_010817829.1 and XP_010816131.1, XM_010817830.1 and XP_010816132.1, XM_010817823.1 and XP_010816125.1, XM_010817824.2 and XP_010816126.1, XM_010817819.2 and XP_010816121.1, XM_010817827.2 and XP_010816129.1, XM_010817828.2 and XP_010816130.1, XM_010817817.2 and) XP_010816119.1, and XM_010817818.2 and XP_010816120.1), mouse PBRM1 (NM_001081251.1 and NP_001074720.1), chicken PBRM1 (NM_205165.1 and NP_990496.1), tropical clawed frog PBRM1 (XM_018090224.1 and XP_017945713.1), zebrafish PBRM1 (XM_009305786.2 and XP_009304061.1, XM_009305785.2 and XP_009304060.1, and XM_009305787.2 and XP_009304062.1), fruit fly PBRM1 (NM_143031.2 and NP_651288.1), and worm PBRM1 (NM_001025837.3 and NP_001021008.1 and. NM_001025838.2 and NP_001021009.1). ReRepresentative sequences of PBRM1 orthologs are presented below in Table 1.

Anti-PBRM1 antibodies suitable for detecting PBRM1 protein are well-known in the art and include, for example, ABE70 (rabbit polyclonal antibody, EMD Millipore, Billerica, Mass.), TA345237 and TA345238 (rabbit polyclonal antibodies, OriGene Technologies, Rockville, Md.), NBP2-30673 (mouse monoclonal) and other polyclonal antibodies (Novus Biologicals, Littleton, Colo.), ab196022 (rabiit mAb, AbCam, Cambridge, Mass.), PAH437Hu01 and PAH437Hu02 (rabbit polyclonal antibodies, Cloud-Clone Corp., Houston, Tex.), GTX100781 (GeneTex, Irvine, Calif.), 25-498 (ProSci, Poway, Calif.), sc-367222 (Santa Cruz Biotechnology, Dallas, Tex.), etc. In addition, reagents are well-known for detecting PBRM1 expression (see, for example, PBRM1 Hu-Cy3 or Hu-Cy5 SmartFlare™ RNA Detection Probe (EMD Millipore). Multiple clinical tests of PBRM1 are available in NIH Genetic Testing Registry (GTR®) (e.g., GTR Test ID: GTR000537378.2 which is offered by Fulgent Clinical Diagnostics Lab (Temple City, Calif.)). Moreover, mutilple siRAN, shRNA, CRISPR constructs for reducing PBRM1 expression can be found in the commercial product lists of the above-referenced companies. Ribavirin and PFI 3 are known PBRM1 inhibitors. It is to be noted that the term can further be used to refer to any combination of features described herein regarding PBRM1 molecules. For example, any combination of sequence composition, percentage identify, sequence length, domain structure, functional activity, etc. can be used to describe an PBRM1 molecule of the present invention.

The term "PBRM1 loss-of-function mutation" refers to any mutation in a PBRM1-related nucleic acid or protein that results in reduced or eliminated PBRM1 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of PBRM1. Such mutations reduce or eliminate PBRM1 protein amounts and/or function by eliminating proper coding sequences required for proper PBRM1 protein translation and/or coding for PBRM1 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated PBRM1 protein amounts and/or function is described in the Tables and the Examples.

The term "BAF250A" or "ARID1A" refers to AT-rich interactive domain-containing protein 1A, a subunit of the SWI/SNF complex, which can be find in BAF but not PBAF complex. In humans there are two BAF250 isoforms, BAF250A/ARID1A and BAF250B/ARID1B. They are thought to be E3 ubiquitin ligases that target histone H2B (Li et al. (2010)*Mol. Cell. Biol.* 30:1673-1688). ARID1A is highly expressed in the spleen, thymus, prostate, testes, ovaries, small intestine, colon and peripheral leukocytes. ARID1A is involved in transcriptional activation and repression of select genes by chromatin remodeling. It is also involved in vitamin D-coupled transcription regulation by associating with the WINAC complex, a chromatin-remodeling complex recruited by vitamin D receptor. ARID1A belongs to the neural progenitors-specific chromatin remodeling (npBAF) and the neuron-specific chromatin remodeling (nBAF) complexes, which are involved in switching developing neurons from stem/progenitors to post-mitotic chromatin remodeling as they exit the cell cycle and become committed to their adult state. ARID1A also plays key roles in maintaining embryonic stem cell pluripotency and in cardiac development and function (Lei et al. (2012) *J. Biol. Chem.* 287:24255-24262; Gao et al. (2008) *Proc. Natl. Acad. Sci. U.S.A.* 105:6656-6661). Loss of BAF250a expression was seen in 42% of the ovarian clear cell carcinoma samples and 21% of the endometrioid carcinoma samples, compared with just 1% of the high-grade serous carcinoma samples. ARID1A deficiency also impairs the DNA damage checkpoint and sensitizes cells to PARP inhibitors (Shen et al. (2015) *Cancer Discov.* 5:752-767). Human ARID1A protein has 2285 amino acids and a molecular mass of 242045 Da, with at least a DNA-binding domain that can specifically bind an AT-rich DNA sequence, recognized by a SWI/SNF complex at the beta-globin locus, and a C-terminus domain for glucocorticoid receptor-dependent transcriptional activation. ARID1A has been shown to interact with proteins such as SMARCB1/BAF47 (Kato et al. (2002) *J. Biol. Chem.* 277:5498-505; Wang et al. (1996) *EMBO J.* 15:5370-5382) and SMARCA4/BRG1 (Wang et al. (1996), supra; Zhao et al. (1998) *Cell* 95:625-636), etc.

The term "BAF250A" or "ARID1A" is intended to include fragments, variants (e.g., allelic variants), and derivatives thereof. Representative human BAF250A (ARID1A) cDNA and human BAF250A (ARID1A) protein sequences are well-known in the art and are publicly available from the National Center for Biotechnology Information (NCBI). For example, two different human ARID1A isoforms are known. Human ARID1A isoform A (NP_006006.3) is encodable by the transcript variant 1 (NM_006015.4), which is the longer transcript. Human ARID1A isoform B (NP_624361.1) is encodable by the transcript variant 2 (NM_139135.2), which lacks a segment in the coding region compared to variant 1. Isoform B thus lacks an internal segment, compared to isoform A. Nucleic acid and polypeptide sequences of ARID1A orthologs in organisms other than humans are well known and include, for example, chimpanzee ARID1A (XM_016956953.1 and XP_016812442.1, XM_016956958.1 and) XP_016812447.1, and XM_009451423.2 and XP_009449698.2), Rhesus monkey ARID1A (XM_015132119.1 and XP_014987605.1, and XM_015132127.1 and XP_014987613.1), dog ARID1A (XM_847453.5 and XP_852546.3, XM_005617743.2 and XP_005617800.1, XM_005617742.2 and XP_005617799.1, XM_005617744.2 and XP_005617801.1, XM_005617746.2 and XP_005617803.1, and XM_005617745.2 and XP_005617802.1), cattle ARID1A (NM_001205785.1 and NP_001192714.1), mouse ARID1A (NM_001080819.1 and NP_001074288.1), rat ARID1A (NM_001106635.1 and NP_001100105.1), chicken ARID1A (XM_015297557.1 and XP_015153043.1, XM_015297556.1 and XP_015153042.1, and XM_417693.5 and XP_417693.5), tropical clawed frog ARID1A (XM_002934639.4 and XP_002934685.2), and zebrafish ARID1A (XM_009294131.2 and XP_009292406.1, and XM_009294132.2 and XP_009292407.1).

Anti-ARID1A antibodies suitable for detecting ARID1A protein are well-known in the art and include, for example, antibody Cat #04-080 (EMD Millipore, Billerica, Mass.), antibodies TA349170, TA350870, and TA350871 (OriGene Technologies, Rockville, Md.), antibodies NBP1-88932, NB100-55334, NBP2-43566, NB100-55333, and H00008289-Q01 (Novus Biologicals, Littleton, Colo.), antibodies ab182560, ab182561, ab176395, and ab97995 (AbCam, Cambridge, Mass.), antibodies Cat #: 12354 and 12854 (Cell Signaling Technology, Danvers, Mass.), antibodies GTX129433, GTX129432, GTX632013, GTX12388, and GTX31619 (GeneTex, Irvine, Calif.), etc. In addition, reagents are well-known for detecting ARID1A expression. For example, multiple clinical tests for ARID1A are available at NIH Genetic Testing Registry (GTR®) (e.g., GTR Test ID: GTR000520952.1 for mental retardation, offered by Centogene AG, Germany). Moreover, multiple siRNA, shRNA, CRISPR constructs for reducing ARID1A Expression can be found in the commercial product lists of the above-referenced companies, such as RNAi products H00008289-R01, H00008289-R02, and H00008289-R03 (Novus Biologicals) and CRISPR products KN301547G1 and KN301547G2 (Origene). Other CRISPR products include sc-400469 (Santa Cruz Biotechnology) and those from GenScript (Piscataway, N.J.). It is to be noted that the term can further be used to refer to any combination of features described herein regarding ARID1A molecules. For example, any combination of sequence composition, percentage identify, sequence length, domain structure, functional activity, etc. can be used to describe an ARID1A molecule of the present invention.

The term "loss-of-function mutation" for BAF250A/ARID1A refers to any mutation in an ARID1A-related nucleic acid or protein that results in reduced or eliminated ARID1A protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID1A. Such mutations reduce or eliminate ARID1A protein amounts and/or function by eliminating proper coding sequences required for proper ARID1A protein translation and/or coding for ARID1A proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated ARID protein amounts and/or function is described in the Tables and the Examples.

The term "BAF250B" or "ARID1B" refers to AT-rich interactive domain-containing protein 1B, a subunit of the SWI/SNF complex, which can be find in BAF but not PBAF complex. ARID1B and ARID1A are alternative and mutually exclusive ARID-subunits of the SWI/SNF complex. Germline mutations in ARID1B are associated with Coffin-Siris syndrome (Tsurusaki et al. (2012) *Nat. Genet.* 44:376-378; Santen et al. (2012) *Nat. Genet.* 44:379-380). Somatic mutations in ARID1B are associated with several cancer subtypes, suggesting that it is a tumor suppressor gene (Shai and Pollack (2013) *PLoS ONE* 8:e55119; Sausen et al. (2013) *Nat. Genet.* 45:12-17; Shain et al. (2012) *Proc. Natl. Acad. Sci. U.S.A.* 109:E252-E259; Fujimoto et al. (2012) *Nat. Genet.* 44:760-764). Human ARID1A protein has 2236 amino acids and a molecular mass of 236123 Da, with at least a DNA-binding domain that can specifically bind an AT-rich DNA sequence, recognized by a SWI/SNF complex at the beta-globin locus, and a C-terminus domain for glucocorticoid receptor-dependent transcriptional activation. ARID1B has been shown to interact with SMARCA4/BRG1 (Hurlstone et al. (2002) *Biochem. J.* 364:255-264; Inoue et al. (2002) *J. Biol. Chem.* 277:41674-41685 and SMARCA2/BRM (Inoue et al. (2002), supra).

The term "BAF250B" or "ARID1B" is intended to include fragments, variants (e.g., allelic variants), and derivatives thereof. Representative human BAF250B (ARID1B) cDNA and human BAF250B (ARID1B) protein sequences are well-known in the art and are publicly available from the National Center for Biotechnology Information (NCBI). For example, three different human ARID1B isoforms are known. Human ARID1B isoform A (NP_059989.2) is encodable by the transcript variant 1 (NM_017519.2). Human ARID isoform B (NP_065783.3) is encodable by the transcript variant 2 (NM_020732.3). Human ARID1B isoform C (NP_001333742.1) is encodable by the transcript variant 3 (NM_001346813.1). Nucleic acid and polypeptide sequences of ARID1B orthologs in organisms other than humans are well known and include, for example, Rhesus monkey ARID1B (XM_015137088.1 and XP_014992574.1), dog ARID1B (XM_014112912.1 and XP_013968387.1), cattle ARID1B (XM_010808714.2 and XP_010807016.1, and XM_015464874.1 and XP_015320360.1), mouse ARID1B (NM_001085355.1 and NP_001078824.1), rat ARID1B (XM_017604567.1 and XP_017460056.1), chicken ARID1B (XM_015284235.1 and XP_015139721.1, XM_015284233.1 and XP_015139719.1, XM_015284238.1 and XP_015139724.1, XM_015284230.1 and XP_015139716.1, XM_015284234.1 and XP_015139720.1, XM_015284231.1 and XP_015139717.1, XM_015284232.1 and XP_015139718.1, XM_015284236.1 and XP_015139722.1, and XM_015284237.1 and XP_015139723.1), tropical clawed frog ARID1B (XM_004914629.3 and XP_004914686.1, XM_004914631.3 and XP_004914688.1, XM_004914630.3 and XP_004914687.1, XM_004914634.3 and XP_004914691.1, XM_002931507.4 and XP_002931553.2, XM_004914632.3 and XP_004914689.1, XM_004914635.3 and XP_004914692.1, XM_004914633.3 and XP_004914690.1, XM_004914636.3 and XP_004914693.1, and XM_004914637.3 and XP_004914694.1), and zebrafish ARID1B XM_009294544.2 and XP_009292819.1, XM_009294545.2 and XP_009292820.1, XM_005160356.3 and XP_005160413.1, XM_005160355.3 and XP_005160412.1, XM_005160354.3 and XP_005160411.1, and XM_692987.8 and XP_698079.4).

Anti-ARID1B antibodies suitable for detecting ARID1B protein are well-known in the art and include, for example, antibody Cat # ABE316 (EMD Millipore, Billerica, Mass.), antibody TA315663 (OriGene Technologies, Rockville, Md.), antibodies H00057492-M02, H00057492-M01, NB100-57485, NBP1-89358, and NB100-57484 (Novus Biologicals, Littleton, Colo.), antibodies ab57461, ab69571, ab84461, and ab163568 (AbCam, Cambridge, Mass.), antibodies Cat #: PAS-38739, PAS-49852, and PAS-50918 (ThermoFisher Scientific, Danvers, Mass.), antibodies GTX130708, GTX60275, and GTX56037 (GeneTex, Irvine, Calif.), ARID1B (KMN1) Antibody and other antibodies (Santa Cruz Biotechnology), etc. In addition, reagents are well-known for detecting ARID1B expression. For example, multiple clinical tests for ARID1B are available at NIH Genetic Testing Registry (GTR®)(e.g., GTR Test ID: GTR000520953.1 for mental retardation, offered by Centogene AG, Germany). Moreover, multiple siRNA, shRNA, CRISPR constructs for reducing ARID1B Expression can be found in the commercial product lists of the above-referenced companies, such as RNAi products H00057492-R03, H00057492-R01, and H00057492-R02 (Novus Biologicals) and CRISPR products KN301548 and KN214830 (Origene). Other CRISPR products include sc-402365 (Santa Cruz Biotechnology) and those from GenScript (Piscataway, N.J.). It is to be noted that the term can further be used to refer to any combination of features described herein regarding ARID1B molecules. For example, any combination of sequence composition, percentage identify, sequence length, domain structure, functional activity, etc. can be used to describe an ARID1B molecule of the present invention.

The term "loss-of-function mutation" for BAF250B/ARID1B refers to any mutation in an ARID1B-related nucleic acid or protein that results in reduced or eliminated ARID1B protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID1B. Such mutations reduce or eliminate ARID1B protein amounts and/or function by eliminating proper coding sequences required for proper ARID1B protein translation and/or coding for ARID1B proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated ARID1B protein amounts and/or function is described in the Tables and the Examples.

The term "CRB1" refers to Crumbs homolog 1, a protein similar to the *Drosophila* crumbs protein and localizes to the inner segment of mammalian photoreceptors. In *Drosophila* crumbs localizes to the stalk of the fly photoreceptor and may be a component of the molecular scaffold that controls proper development of polarity in the eye. CRB1 gene is involved in the Hippo signaling pathway. Mutations in this gene are associated with a severe form of retinitis pigmentosa, RP12, and with Leber congenital amaurosis. One study suggests that mutations in this gene are associated with keratoconus in patients that already have Leber's congenital amaurosis (McMahon et al. (2009) *Invest. Ophthalmol. Vis. Sci.* 50:3185-3187). CRB1 mutation is also related to lung squamous cell carcinoma (SQCC) (Li et al. (2015) *Sci. Rep.* 5:Article 14237) and retinal dystrophy (Li et al. (2014) *Int J Mol Med* 33:913-918). The human CRB1 protein has 1406 amino acids and a molecular mass of 154183 Da.

The term "CRB1" is intended to include fragments, variants (e.g., allelic variants), and derivatives thereof. Representative human CRB1 cDNA and human CRB1 protein sequences are well-known in the art and are publicly available from the National Center for Biotechnology Information (NCBI). For example, four different human CRB1 isoforms are known. Human CRB1 isoform A (NP_957705.1) is the longest isoform and is encodable by the transcript variant 1 (NM_201253.2). Human CRB1 isoform B (NP_001180569.1) is encodable by the transcript variant 2 (NM_001193640.1), which lacks two in-frame exons compared to variant 1. The resulting isoform B has the same N- and C-termini but is shorter compared to isoform A. Human CRB1 isoform C (NP_001244894.1) is encodable by the transcript variant 3 (NM_001257965.1), which contains three noncoding exons in place of the first exon and contains an alternate in-frame exon compared to variant 1. The resulting isoform C is shorter at the N-terminus and contains an alternate internal segment compared to isoform A. Human CRB1 isoform D (NP_001244895.1) is encodable by the transcript variant 4 (NM_001257966.1), which lacks an alternate in-frame segment of two coding exons and most of a third compared to variant 1. The resulting isoform D has the same N- and C-termini but lacks an alternate internal segment compared to isoform A. Nucleic acid and polypeptide sequences of CRB1 orthologs in organisms other than humans are well known and include, for example, chimpanzee CRB1 (XM_009440300.2 and XP_009438575.1, XM_009440289.2 and XP_009438564.1, XM_009440291.2 and XP_009438566.1, XM_016934908.1 and XP_016790397.1, XM_016934919.1 and XP_016790408.1, XM_016934927.1 and XP_016790416.1, XM_525009.5 and XP_525009.2, and XM_016934898.1 and XP_016790387.1), Rhesus monkey CRB1 (XM_015120817.1 and XP_014976303.1, XM_001110878.3 and XP_001110878.2, XM_001110912.3 and XP_001110912.2, XM_015120808.1 and XP_014976294.1, and XM_015120812.1 and XP_014976298.1), dog CRB1 (XM_014115056.1 and XP_013970531.1, XM_014115058.1 and XP_013970533.1, XM_005622293.2 and XP_005622350.1, and XM_014115057.1 and XP_013970532.1), cattle CRB1 (XM_010813559.2 and XP_010811861.1), mouse CRB1 (NM_133239.2 and NP_573502.2), rat CRB1 (NM_001107182.1 and NP_001100652.1), chicken CRB1 (XM_015290380.1 and XP_015145866.1, and XM_003641670.3 and XP_003641718.2), tropical clawed frog ARID1B (XM_018093205.1 and XP_017948694.1), and zebrafish CRB1 (NM_001044943.1 and NP_001038408.1).

Anti-CRB1 antibodies suitable for detecting CRB1 protein are well-known in the art and include, for example, antibody Cat # MABN1572 and ABE553 (EMD Millipore, Billerica, Mass.), antibody TA319859 (OriGene Technologies, Rockville, Md.), antibody NBP2-41201 (Novus Biologicals, Littleton, Colo.), antibody ab156282 (AbCam, Cambridge, Mass.), antibody GTX32103 (GeneTex, Irvine, Calif.), CRB1 (H-14) Antibody (Santa Cruz Biotechnology), etc. In addition, reagents are well-known for detecting CRB1 expression. For example, multiple clinical tests for CRB1 are available at NIH Genetic Testing Registry (GTR®) (e.g., GTR Test ID: GTR000515886.2 for retinitis pigmentosa type 12, offered by Centogene AG, Germany). Moreover, multiple siRNA, shRNA, CRISPR constructs for reducing CRB1 Expression can be found in the commercial product lists of the above-referenced companies, such as RNAi products H00023418-R01 and H00023418-R02 (Novus Biologicals) and CRISPR products KN303799 and KN212347 (Origene). Other CRISPR products include sc-418097 (Santa Cruz Biotechnology) and those from GenScript (Piscataway, N.J.). It is to be noted that the term can further be used to refer to any combination of features described herein regarding CRB1 molecules. For example, any combination of sequence composition, percentage identify, sequence length, domain structure, functional activity, etc. can be used to describe an CRB1 molecule of the present invention.

The term "loss-of-function mutation" for CRB1 refers to any mutation in a CRB1-related nucleic acid or protein that results in reduced or eliminated CRB1 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of CRB1. Such mutations reduce or eliminate CRB1 protein amounts and/or function by eliminating proper coding sequences required for proper CRB1 protein translation and/or coding for CRB1 proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated CRB1 protein amounts and/or function is described in the Tables and the Examples.

The term "EGFR" refers to the epidermal growth factor receptor, a transmembrane glycoprotein that is a member of the ErbB family of receptors, a subfamily of four closely related receptor tyrosine kinases: EGFR (ErbB-1), HER2/c-neu (ErbB-2), Her 3 (ErbB-3) and Her 4 (ErbB-4). This protein is a receptor for members of the epidermal growth factor family. Binding of the protein to a ligand induces receptor homo- and/or heterodimerization and tyrosine autophosphorylation on key cytoplasmic residues. The activated EGFR then recruits adapter proteins like GRB2 which in turn activates complex downstream signaling cascades, leading to cell proliferation. Known ligands of EGFR include EGF, TGFA/TGF-alpha, amphiregulin, epigen/EPGN, BTC/betacellulin, epiregulin/EREG and HBEGF/heparin-binding EGF. While being activated, autophosphorylation of several tyrosine (Y) residues in the C-terminal domain of EGFR occurs. These include Y992, Y1045, Y1068, Y1148 and Y1173, as shown in the adjacent diagram (Downward et al. (1984) *Nature* 311:483-485). This autophosphorylation elicits downstream activation and signaling by several other proteins that associate with the phosphorylated tyrosines through their own phosphotyrosine-binding SH2 domains. These downstream signaling proteins initiate several signal transduction cascades, principally the MAPK, Akt and JNK pathways, leading to DNA synthesis and cell proliferation (Oda et al. (2005) *Mol. Sys. Biol.* 1:2005.0010). Such proteins modulate phenotypes such as cell migration, adhesion, and proliferation. Activation of the receptor is important for the innate immune response in human skin. The kinase domain of EGFR can also cross-phosphorylate tyrosine residues of other receptors it is aggregated with, and can itself be activated in that manner. EGFR activates at least 4 major downstream signaling cascades including the RAS-RAF-MEK-ERK, PI3 kinase-AKT, PLCgamma-PKC and STATs modules. EGFR may also activate the NF-kappa-B signaling cascade and other proteins like RGS16, by activating its GTPase activity, and probably coupling the EGF receptor signaling to the G protein-coupled receptor signaling. EGFR also phosphorylates MUC1 and increases its interaction with SRC and CTNNB1/beta-catenin. Mutations that lead to EGFR overexpression (i.e., upregulation) or overactivity have been associated with a number of cancers, including squamous-cell carcinoma of the lung (80% of cases), anal cancers (Walker et al. (2009) *Hum. Pathol.* 40:1517-1527), glioblastoma (50%) and epithelian tumors of the head and neck (80-100%) (Kumar et al. (2013) *Robbins basic pathology*. Philadelphia: Elsevier/Saunders. p. 179). These somatic mutations involving EGFR lead to its constant activation, which produces uncontrolled cell division. In glioblastoma a more or less specific mutation of EGFR, called EGFRvIII is often observed (Kuan et al. (2001) *Endocr. Relat. Cancer.* 8:83-96). Aberrant EGFR signaling has been implicated in psoriasis, eczema and atherosclerosis (Jost et al. (2000) *Eur. J. Dermatol.* 10:505-510; Dreux et al. (2006) *Atherosclerosis* 186:38-53). However, its exact roles in these conditions are ill-defined. Human EGFR protein has 1210 amino acids and a molecular mass of 134277 Da, with at least a receptor L domain (amino acid no. 57-168 of SEQ ID NO:92), a Furin-like domain (amino acd no. 185-335 of SDEQ ID NO:92), another receptor L domain (amino acid no. 361-481 of SEQ ID NO:92), a growth factor receptor domain IV (amino acid no. 505-637 of SEQ ID NO:92), a transmembrane region (amino acid no. 646-668 of SEQ ID NO:92), and a catalytic domain of the protein tyrosince kinase family (amino acid no. 704-1016 of SEQ ID NO:92). The structure and domains of human EGFR may be found at the World Wide Web address of www.uniprot.org/uniprot/P00533#structure and www.ebi.ac.uk/interpro/protein/P00533. EGFR has been shown to interact with proteins such as AR, ARF4, CAV1, CAV3, CBL, CBLB, CBLC, CD44, CDC25A, CRK, CTNNB1, DCN, EGF, GRB14, Grb2, JAK2, MUC1, NCK1, NCK2, PKC alpha, PLCG1, PLSCR1, PTPN1, PTPN11, PTPN6, PTPRK, SH2D3A, SH3KBP1, SHC1, SOS1, Src, STAT1, STAT3, STAT5A, UBC, and WAS.

The term "EGFR" is intended to include fragments, variants (e.g., allelic variants), and derivatives thereof. Representative human EGFR cDNA and human EGFR protein sequences are well-known in the art and are publicly available from the National Center for Biotechnology Information (NCBI). For example, nine different human EGFR isoforms are known. Human EGFR isoform A (NP_005219.2), the longest isoform, is encodable by the transcript variant 1 (NM_005228.4). Human EGFR isoform B (NP_958439.1) is encodable by the transcript variant 2 (NM_201282.1), which uses a different 3' terminal exon when compared to variant 1. The resulting isoform B has a shorter and distinct C-terminus. Human EGFR isoform C (also known as ErbB1-S, NP_958440.1) is encodable by the transcript variant 3 (NM_201283.1), which uses a different 3' terminal exon when compared to variant 1. The resulting isoform C has a shorter and distinct C-terminus. Only the extracellular domain is present in isoform C. Human EGFR isoform D (NP_958441.1) is encodable by the transcript variant 4 (NM_201284.1), which uses a different 3' terminal exon when compared to variant 1. The resulting isoform D has a shorter and distinct C-terminus. Only the extracellular domain is present in isoform D. Human EGFR isoform E (NP_001333826.1) is encodable by the transcript variant 5 (NM_001346897.1), which lacks an in-frame exon in the 5' coding region and its 3' terminal exon extends past a splice site that is used in variant 1. The encoded isoform E is shorter and has a distinct C-terminus compared to isoform A. Human EGFR isoform F (NP_001333827.1) is encodable by the transcript variant 6 (NM_001346898.1), which has a 3' terminal exon that extends past a splice site that is used in variant 1. The encoded isoform F has a shorter and distinct C-terminus compared to isoform A. Human EGFR isoform G (NP_001333828.1) is encodable by the transcript variant 7 (NM_001346899.1), which lacks an in-frame exon in the 5' coding region, compared to variant 1. Human EGFR isoform H (NP_001333829.1) is encodable by the transcript variant 8 (NM_001346900.1), which uses a novel 5' terminal exon compared to variant 1. The encoded isoform H has a shorter and distinct N-terminus compared to isoform A. Human EGFR isoform I (a.k.a. EGFRvIII, delta-EGFR, and de2-7EGFR; NP_001333870.1) is encodable by the transcript variant 9 (NM_001346941.1), which has an in-frame deletion of six exons in the 5' coding region, compared to variant 1. The encoded isoform I has a shorter extracellular domain compared to isoform A. This variant is considered to be tumorigenic and the encoded protein lacks normal ligand binding ability and is constitutively active. Nucleic acid and polypeptide sequences of EGFR orthologs in organisms other than humans are well known and include, for example, chimpanzee EGFR (XM_519102.6 and XP_519102.3, and XM_001156264.5 and XP_001156264.1), Rhesus monkey EGFR (XM_015133436.1 and XP_014988922.1, and XM_015133437.1 and XP_014988923.1), dog EGFR (XM_014120756.1 and XP_013976231.1), cattle EGFR (XM_002696890.4 and XP_002696936.2, and XM_592211.8 and XP_592211.4), mouse EGFR (NM_007912.4 and NP_031938.1, and NM_207655.2 and NP_997538.1), rat EGFR (NM_031507.1 and NP_113695.1, XM_008770416.2 and XP_008768638.1, XM_008770418.2 and XP_008768640.1, and XM_017599073.1 and XP_017454562.1), chicken EGFR (NM_205497.2 and NP_990828.2), tropical clawed frog EGFR (XM_002939914.4 and XP_002939960.2), and zebrafish EGFR (NM_194424.1 and NP_919405.1).

Anti-EGFR antibodies suitable for detecting EGFR protein are well-known in the art and include, for example, antibody Cat #06-847 (EMD Millipore, Billerica, Mass.), antibodies AM00029BT-N, AM00029PU-N, and others (OriGene Technologies, Rockville, Md.), antibodies Cat # MAB8967, AF231, AF1095, and others (R&D Systems, Minneapolis, Minn.), antibodies NB120-10414, NBP1-84814, and others (Novus Biologicals, Littleton, Colo.), antibodies ab52894, ab40815, and others (AbCam, Cambridge, Mass.), antibodies Cat #: 4267, 2244, 48685, and others (Cell Signaling Technology, Danvers, Mass.), antibodies GTX121919, GTX628887, and others (GeneTex, Irvine, Calif.), etc. In addition, reagents are well-known for detecting EGFR expression. For example, multiple clinical tests for EGFR are available at NIH Genetic Testing Registry (GTR®) (e.g., GTR Test ID: GTR000514557.2 for EGFR mutation by Sanger Sequencing, offered by Cancer Genetics, Inc. (Rutherford, N.J.), GTR Test ID: GTR000510455.1 for lung cancer, offered by Centogene AG, Germany, and other tests). Commercial ELISA kits for detecting EGFR are available, at least, from R&D Systems (Cat # DYC1095B-2, DYC1854-2, DEGFRO, DYC3570-2, etc.). Moreover, multiple siRNA, shRNA, CRISPR constructs for reducing EGFR Expression can be found in the commercial product lists of the above-referenced companies, such as RNAi products SC-29301, SC-44340, and others and CRISPR products sc-400015 (Santa Cruz Biotechnology). Other similar products include TG320326, TR320326, TG509941, and others shRNA products, as well as KN214877, KN204201, and others CRISPR products (Origene). Small molecule compounds are known to regulate EGFR expression, such as Cat.# A8197 and other inhibitors (ApexBio, Houston, Tex.), CAS 879127-07-8 and other inhibitors or activators (EMD Millipore). Known EGFR inhibitory drugs include, at least, Iressa™ (gefitinib), Tarceva™ (erlotinib), Tykerb™ (lapatinib), Erbitux™ (cetuximab), Vectibix™ (panitumumab), Caprelsa™ (vandetanib), Tagrisso™ (osimertinib), Portrazza™ (necitumumab), etc. It is to be noted that the term can further be used to refer to any combination of features described herein regarding EGFR molecules. For example, any combination of sequence composition, percentage identify, sequence length, domain structure, functional activity, etc. can be used to describe an EGFR molecule of the present invention.

The term "loss-of-function mutation" for EGFR refers to any mutation in an EGFR-related nucleic acid or protein that results in reduced or eliminated EGFR protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of EGFR. Such mutations reduce or eliminate EGFR protein amounts and/or function by eliminating proper coding sequences required for proper EGFR protein translation and/or coding for EGFR proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated EGFR protein amounts and/or function is described in the Tables and the Examples. In some embodiments, the term "hotspot mutation" for EGFR refers to a mutation that is commonly known to be mutated in EGFR associated with cancer. In some instances, such "hotspot mutations" can be those known to cause resistance to anti-EGFR therapies such as those described in Example 4.

Unless otherwise specified here within, the terms "antibody" and "antibodies" broadly encompass naturally-occurring forms of antibodies (e.g. IgG, IgA, IgM, IgE) and recombinant antibodies such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

The term "antibody" as used herein also includes an "antigen-binding portion" of an antibody (or simply "antibody portion"). The term "antigen-binding portion", as used herein, refers to one or more fragments of an antibody that retain the ability to specifically bind to an antigen (e.g., a biomarker polypeptide or fragment thereof). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al. (1989) *Nature* 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent polypeptides (known as single chain Fv (scFv); see e.g., Bird et al. (1988) *Science* 242:423-426; and Huston et al. (1988) *Proc. Natl. Acad. Sci. USA* 85:5879-5883; and Osbourn et al. 1998, *Nature Biotechnology* 16: 778). Such single chain antibodies are also intended to be encompassed within the term "antigen-binding portion" of an antibody. Any VH and VL sequences of specific scFv can be linked to human immunoglobulin constant region cDNA or genomic sequences, in order to generate expression vectors encoding complete IgG polypeptides or other isotypes. VH and VL can also be used in the generation of Fab, Fv or other fragments of immunoglobulins using either protein chemistry or recombinant DNA technology. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al. (1993) *Proc. Natl. Acad. Sci. USA* 90:6444-6448; Poljak, R. J., et al. (1994) *Structure* 2:1121-1123).

Still further, an antibody or antigen-binding portion thereof may be part of larger immunoadhesion polypeptides, formed by covalent or noncovalent association of the antibody or antibody portion with one or more other proteins or peptides. Examples of such immunoadhesion polypeptides include use of the streptavidin core region to make a tetrameric scFv polypeptide (Kipriyanov, S. M., et al. (1995) *Human Antibodies and Hybridomas* 6:93-101) and use of a cysteine residue, biomarker peptide and a C-terminal polyhistidine tag to make bivalent and biotinylated scFv polypeptides (Kipriyanov, S. M., et al. (1994) *Mol. Immunol.* 31:1047-1058). Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion polypeptides can be obtained using standard recombinant DNA techniques, as described herein.

Antibodies may be polyclonal or monoclonal; xenogeneic, allogeneic, or syngeneic; or modified forms thereof (e.g. humanized, chimeric, etc.). Antibodies may also be fully human. Preferably, antibodies of the present invention bind specifically or substantially specifically to a biomarker polypeptide or fragment thereof. The terms "monoclonal antibodies" and "monoclonal antibody composition", as used herein, refer to a population of antibody polypeptides that contain only one species of an antigen binding site capable of immunoreacting with a particular epitope of an antigen, whereas the term "polyclonal antibodies" and "polyclonal antibody composition" refer to a population of antibody polypeptides that contain multiple species of antigen binding sites capable of interacting with a particular antigen. A monoclonal antibody composition typically displays a single binding affinity for a particular antigen with which it immunoreacts.

Antibodies may also be "humanized", which is intended to include antibodies made by a non-human cell having variable and constant regions which have been altered to more closely resemble antibodies that would be made by a human cell. For example, by altering the non-human antibody amino acid sequence to incorporate amino acids found in human germline immunoglobulin sequences. The humanized antibodies of the present invention may include amino acid residues not encoded by human germline immunoglobulin sequences (e.g., mutations introduced by random or site-specific mutagenesis in vitro or by somatic mutation in vivo), for example in the CDRs. The term "humanized antibody", as used herein, also includes antibodies in which CDR sequences derived from the germline of another mammalian species, such as a mouse, have been grafted onto human framework sequences.

The term "assigned score" refers to the numerical value designated for each of the biomarkers after being measured in a patient sample. The assigned score correlates to the absence, presence or inferred amount of the biomarker in the sample. The assigned score can be generated manually (e.g., by visual inspection) or with the aid of instrumentation for image acquisition and analysis. In certain embodiments, the assigned score is determined by a qualitative assessment, for example, detection of a fluorescent readout on a graded scale, or quantitative assessment. In one embodiment, an "aggregate score," which refers to the combination of assigned scores from a plurality of measured biomarkers, is determined. In one embodiment the aggregate score is a summation of assigned scores. In another embodiment, combination of assigned scores involves performing mathematical operations on the assigned scores before combining them into an aggregate score. In certain embodiments, the aggregate score is also referred to herein as the "predictive score."

The term "biomarker" refers to a measurable entity of the present invention that has been determined to be predictive of immune checkpoint therapy effects on a cancer. Biomarkers can include, without limitation, nucleic acids and proteins, including those shown in Table 1, the Examples, and the Figures.

A "blocking" antibody or an antibody "antagonist" is one which inhibits or reduces at least one biological activity of the antigen(s) it binds. In certain embodiments, the blocking antibodies or antagonist antibodies or fragments thereof described herein substantially or completely inhibit a given biological activity of the antigen(s).

The term "body fluid" refers to fluids that are excreted or secreted from the body as well as fluids that are normally not (e.g. amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit).

The terms "cancer" or "tumor" or "hyperproliferative" refer to the presence of cells possessing characteristics typical of cancer-causing cells, such as uncontrolled proliferation, immortality, metastatic potential, rapid growth and proliferation rate, and certain characteristic morphological features. In some embodiments, such cells exhibit such characteristics in part or in full due to the expression and activity of immune checkpoint proteins, such as PD-1, PD-L1, and/or CTLA-4. Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, B cell cancer, e.g., multiple myeloma, Waldenstrom's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematologic tissues, and the like. Other non-limiting examples of types of cancers applicable to the methods encompassed by the present invention include human sarcomas and carcinomas, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, colorectal cancer, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, liver cancer, choriocarcinoma, seminoma, embryonal carcinoma, Wilms' tumor, cervical cancer, bone cancer, brain tumor, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma; leukemias, e.g., acute lymphocytic leukemia and acute myelocytic leukemia (myeloblastic, promyelocytic, myelomonocytic, monocytic and erythroleukemia); chronic leukemia (chronic myelocytic (granulocytic) leukemia and chronic lymphocytic leukemia); and polycythemia vera, lymphoma (Hodgkin's disease and non-Hodgkin's disease), multiple myeloma, Waldenstrom's macroglobulinemia, and heavy chain disease. In some embodiments, cancers are epithlelial in nature and include but are not limited to, bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, Brenner, or undifferentiated.

The term "coding region" refers to regions of a nucleotide sequence comprising codons which are translated into amino acid residues, whereas the term "noncoding region" refers to regions of a nucleotide sequence that are not translated into amino acids (e.g., 5' and 3' untranslated regions).

The term "complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The terms "conjoint therapy" and "combination therapy," as used herein, refer to the administration of two or more therapeutic substances, e.g., combinations of anti-immune checkpoint therapies, multiple inhibitors of an immune checkpoint of interest, combinations of immune checkpoint therapy with an inhibitor of PBRM1 (ARID2, BRD7, PHF10, KDM6A, ARID1A, ARID1B, BRG1, BRM, CRB1, EGFR, and the like), and combinations thereof. The different agents comprising the combination therapy may be administered concomitant with, prior to, or following the administration of one or more therapeutic agents.

The term "control" refers to any reference standard suitable to provide a comparison to the expression products in the test sample. In one embodiment, the control comprises obtaining a "control sample" from which expression product levels are detected and compared to the expression product levels from the test sample. Such a control sample may comprise any suitable sample, including but not limited to a sample from a control cancer patient (can be stored sample or previous sample measurement) with a known outcome; normal tissue or cells isolated from a subject, such as a normal patient or the cancer patient, cultured primary cells/tissues isolated from a subject such as a normal subject or the cancer patient, adjacent normal cells/tissues obtained from the same organ or body location of the cancer patient, a tissue or cell sample isolated from a normal subject, or a primary cells/tissues obtained from a depository. In another preferred embodiment, the control may comprise a reference standard expression product level from any suitable source, including but not limited to housekeeping genes, an expression product level range from normal tissue (or other previously analyzed control sample), a previously determined expression product level range within a test sample from a group of patients, or a set of patients with a certain outcome (for example, survival for one, two, three, four years, etc.) or receiving a certain treatment (for example, standard of care cancer therapy). It will be understood by those of skill in the art that such control samples and reference standard expression product levels can be used in combination as controls in the methods of the present invention. In one embodiment, the control may comprise normal or non-cancerous cell/tissue sample. In another preferred embodiment, the control may comprise an expression level for a set of patients, such as a set of cancer patients, or for a set of cancer patients receiving a certain treatment, or for a set of patients with one outcome versus another outcome. In the former case, the specific expression product level of each patient can be assigned to a percentile level of expression, or expressed as either higher or lower than the mean or average of the reference standard expression level. In another preferred embodiment, the control may comprise normal cells, cells from patients treated with combination chemotherapy, and cells from patients having benign cancer. In another embodiment, the control may also comprise a measured value for example, average level of expression of a particular gene in a population compared to the level of expression of a housekeeping gene in the same population. Such a population may comprise normal subjects, cancer patients who have not undergone any treatment (i.e., treatment naive), cancer patients undergoing standard of care therapy, or patients having benign cancer. In another preferred embodiment, the control comprises a ratio transformation of expression product levels, including but not limited to determining a ratio of expression product levels of two genes in the test sample and comparing it to any suitable ratio of the same two genes in a reference standard; determining expression product levels of the two or more genes in the test sample and determining a difference in expression product levels in any suitable control; and determining expression product levels of the two or more genes in the test sample, normalizing their expression to expression of housekeeping genes in the test sample, and comparing to any suitable control. In particularly preferred embodiments, the control comprises a control sample which is of the same lineage and/or type as the test sample. In another embodiment, the control may comprise expression product levels grouped as percentiles within or based on a set of patient samples, such as all patients with cancer. In one embodiment a control expression product level is established wherein higher or lower levels of expression product relative to, for instance, a particular percentile, are used as the basis for predicting outcome. In another preferred embodiment, a control expression product level is established using expression product levels from cancer control patients with a known outcome, and the expression product levels from the test sample are compared to the control expression product level as the basis for predicting outcome. As demonstrated by the data below, the methods of the present invention are not limited to use of a specific cut-point in comparing the level of expression product in the test sample to the control.

The "copy number" of a biomarker nucleic acid refers to the number of DNA sequences in a cell (e.g., germline and/or somatic) encoding a particular gene product. Generally, for a given gene, a mammal has two copies of each gene. The copy number can be increased, however, by gene amplification or duplication, or reduced by deletion. For example, germline copy number changes include changes at one or more genomic loci, wherein said one or more genomic loci are not accounted for by the number of copies in the normal complement of germline copies in a control (e.g., the normal copy number in germline DNA for the same species as that from which the specific germline DNA and corresponding copy number were determined). Somatic copy number changes include changes at one or more genomic loci, wherein said one or more genomic loci are not accounted for by the number of copies in germline DNA of a control (e.g., copy number in germline DNA for the same subject as that from which the somatic DNA and corresponding copy number were determined).

The "normal" copy number (e.g., germline and/or somatic) of a biomarker nucleic acid or "normal" level of expression of a biomarker nucleic acid or protein is the activity/level of expression or copy number in a biological sample, e.g., a sample containing tissue, whole blood, serum, plasma, buccal scrape, saliva, cerebrospinal fluid, urine, stool, and bone marrow, from a subject, e.g., a human, not afflicted with cancer, or from a corresponding non-cancerous tissue in the same subject who has cancer.

As used herein, the term "costimulate" with reference to activated immune cells includes the ability of a costimulatory molecule to provide a second, non-activating receptor mediated signal (a "costimulatory signal") that induces proliferation or effector function. For example, a costimulatory signal can result in cytokine secretion, e.g., in a T cell that has received a T cell-receptor-mediated signal. Immune cells that have received a cell-receptor mediated signal, e.g., via an activating receptor are referred to herein as "activated immune cells."

The term "determining a suitable treatment regimen for the subject" is taken to mean the determination of a treatment regimen (i.e., a single therapy or a combination of different therapies that are used for the prevention and/or treatment of the cancer in the subject) for a subject that is started, modified and/or ended based or essentially based or at least partially based on the results of the analysis according to the present invention. One example is determining whether to provide targeted therapy against a cancer to provide immunotherapy that generally increases immune responses against the cancer (e.g., immune checkpoint therapy). Another example is starting an adjuvant therapy after surgery whose purpose is to decrease the risk of recurrence, another would be to modify the dosage of a particular chemotherapy. The determination can, in addition to the results of the analysis according to the present invention, be based on personal characteristics of the subject to be treated. In most cases, the actual determination of the suitable treatment regimen for the subject will be performed by the attending physician or doctor.

The term "diagnosing cancer" includes the use of the methods, systems, and code of the present invention to determine the presence or absence of a cancer or subtype thereof in an individual. The term also includes methods, systems, and code for assessing the level of disease activity in an individual.

A molecule is "fixed" or "affixed" to a substrate if it is covalently or non-covalently associated with the substrate such that the substrate can be rinsed with a fluid (e.g. standard saline citrate, pH 7.4) without a substantial fraction of the molecule dissociating from the substrate.

The term "expression signature" or "signature" refers to a group of two or more coordinately expressed biomarkers. For example, the genes, proteins, metabolites, and the like making up this signature may be expressed in a specific cell lineage, stage of differentiation, or during a particular biological response. The biomarkers can reflect biological aspects of the tumors in which they are expressed, such as the cell of origin of the cancer, the nature of the non-malignant cells in the biopsy, and the oncogenic mechanisms responsible for the cancer. Expression data and gene expression levels can be stored on computer readable media, e.g., the computer readable medium used in conjunction with a microarray or chip reading device. Such expression data can be manipulated to generate expression signatures.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-AT- TGCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

The term "immune cell" refers to cells that play a role in the immune response. Immune cells are of hematopoietic origin, and include lymphocytes, such as B cells and T cells; natural killer cells; myeloid cells, such as monocytes, macrophages, eosinophils, mast cells, basophils, and granulocytes.

The term "immune checkpoint" refers to a group of molecules on the cell surface of CD4+ and/or CD8+ T cells that fine-tune immune responses by down-modulating or inhibiting an anti-tumor immune response. Immune checkpoint proteins are well known in the art and include, without limitation, CTLA-4, PD-1, VISTA, B7-H2, B7-H3, PD-L1, B7-H4, B7-H6, 2B4, ICOS, HVEM, PD-L2, CD160, gp49B, PIR-B, KIR family receptors, TIM-1, TIM-3, TIM-4, LAG-3, BTLA, SIRPalpha (CD47), CD48, 2B4 (CD244), B7.1, B7.2, ILT-2, ILT-4, TIGIT, and A2aR (see, for example, WO 2012/177624). The term further encompasses biologically active protein fragment, as well as nucleic acids encoding full-length immune checkpoint proteins and biologically active protein fragments thereof.

In some embodiment, the term further encompasses any fragment according to homology descriptions provided herein.

"Immune checkpoint therapy" refers to the use of agents that inhibit immune checkpoint nucleic acids and/or proteins. Inhibition of one or more immune checkpoints can block or otherwise neutralize inhibitory signaling to thereby upregulate an immune response in order to more efficaciously treat cancer. Exemplary agents useful for inhibiting immune checkpoints include antibodies, small molecules, peptides, peptidomimetics, natural ligands, and derivatives of natural ligands, that can either bind and/or inactivate or inhibit immune checkpoint proteins, or fragments thereof; as well as RNA interference, antisense, nucleic acid aptamers, etc. that can downregulate the expression and/or activity of immune checkpoint nucleic acids, or fragments thereof. Exemplary agents for upregulating an immune response include antibodies against one or more immune checkpoint proteins block the interaction between the proteins and its natural receptor(s); a non-activating form of one or more immune checkpoint proteins (e.g., a dominant negative polypeptide); small molecules or peptides that block the interaction between one or more immune checkpoint proteins and its natural receptor(s); fusion proteins (e.g. the extracellular portion of an immune checkpoint inhibition protein fused to the Fc portion of an antibody or immunoglobulin) that bind to its natural receptor(s); nucleic acid molecules that block immune checkpoint nucleic acid transcription or translation; and the like. Such agents can directly block the interaction between the one or more immune checkpoints and its natural receptor(s) (e.g., antibodies) to prevent inhibitory signaling and upregulate an immune response. Alternatively, agents can indirectly block the interaction between one or more immune checkpoint proteins and its natural receptor(s) to prevent inhibitory signaling and upregulate an immune response. For example, a soluble version of an immune checkpoint protein ligand such as a stabilized extracellular domain can binding to its receptor to indirectly reduce the effective concentration of the receptor to bind to an appropriate ligand. In one embodiment, anti-PD-1 antibodies, anti-PD-L1 antibodies, and anti-CTLA-4 antibodies, either alone or in combination, are used to inhibit immune checkpoints.

"Ipilimumab" is a reRepresentative example of an immune checkpoint therapy. Ipilimumab (previously MDX-010; Medarex Inc., marketed by Bristol-Myers Squibb as YERVOY™) is a fully human anti-human CTLA-4 monoclonal antibody that blocks the binding of CTLA-4 to CD80 and CD86 expressed on antigen presenting cells, thereby, blocking the negative down-regulation of the immune responses elicited by the interaction of these molecules (see, for example, WO 2013/169971, U.S. Pat. Publ. 2002/0086014, and U.S. Pat. Publ. 2003/0086930.

The term "immune response" includes T cell mediated and/or B cell mediated immune responses. Exemplary immune responses include T cell responses, e.g., cytokine production and cellular cytotoxicity. In addition, the term immune response includes immune responses that are indirectly effected by T cell activation, e.g., antibody production (humoral responses) and activation of cytokine responsive cells, e.g., macrophages.

The term "immunotherapeutic agent" can include any molecule, peptide, antibody or other agent which can stimulate a host immune system to generate an immune response to a tumor or cancer in the subject. Various immunotherapeutic agents are useful in the compositions and methods described herein.

The term "inhibit" includes the decrease, limitation, or blockage, of, for example a particular action, function, or interaction. In some embodiments, cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

The term "interaction", when referring to an interaction between two molecules, refers to the physical contact (e.g., binding) of the molecules with one another. Generally, such an interaction results in an activity (which produces a biological effect) of one or both of said molecules.

An "isolated protein" refers to a protein that is substantially free of other proteins, cellular material, separation medium, and culture medium when isolated from cells or produced by recombinant DNA techniques, or chemical precursors or other chemicals when chemically synthesized. An "isolated" or "purified" protein or biologically active portion thereof is substantially free of cellular material or other contaminating proteins from the cell or tissue source from which the antibody, polypeptide, peptide or fusion protein is derived, or substantially free from chemical precursors or other chemicals when chemically synthesized. The language "substantially free of cellular material" includes preparations of a biomarker polypeptide or fragment thereof, in which the protein is separated from cellular components of the cells from which it is isolated or recombinantly produced. In one embodiment, the language "substantially free of cellular material" includes preparations of a biomarker protein or fragment thereof, having less than about 30% (by dry weight) of non-biomarker protein (also referred to herein as a "contaminating protein"), more preferably less than about 20% of non-biomarker protein, still more preferably less than about 10% of non-biomarker protein, and most preferably less than about 5% non-biomarker protein. When antibody, polypeptide, peptide or fusion protein or fragment thereof, e.g., a biologically active fragment thereof, is recombinantly produced, it is also preferably substantially free of culture medium, i.e., culture medium represents less than about 20%, more preferably less than about 10%, and most preferably less than about 5% of the volume of the protein preparation.

The term "KDM6A" refers to a particular lysine demethylase containing a JmjC-domain that catalyzes the demethylation of tri-/di-methylated histone H3. The term "KDM6A" is intended to include fragments, variants (e.g., allelic variants), and derivatives thereof. ReRepresentative human KDM6A cDNA and human KDM6A protein sequences are well-known in the art and are publicly available from the National Center for Biotechnology Information (NCBI). For example, the nucleic acid and amino acid sequences of a representative human KDM6A biomarker (also known as UTX or MGC141941 or bA386N14.2 or DKFZp686A03225) is available to the public at the GenBank database under NM_021140.2 and NP_0066963.2. Nucleic acid and polypeptide sequences of KDM6A orthologs in organisms other than humans are well known and include, for example, mouse KDM6A (NM_009483.1 and NP_033509.1), rat KDM6A (XM_002730185.2 and XP_002730231.1), chimpanzee KDM6A (XM_002806207.1 and XP_002806253.1), chicken KDM6A (XM_416762.3 and XP_416762.3), fruit fly KDM6A (NM_001201844.1 and NP_001188773.1), and worm KDM6A (NM_077049.3 and NP_509450.1). Representative sequences of KDM6A orthologs are presented below in Table 1.

Anti-KDM6A antibodies suitable for detecting KDM6A protein are well-known in the art and include, for example, antibody ab36938 (Abcam), 16F9.1 (EMD Millipore), PAS-31828 (ThermoFisher), NBP1-80628 and H00007403-M05 (Novus Biologicals), etc. Moreover, mutilple siRNA, shRNA, CRISPR constructs for reducing KDM6A expression can be found in the commercial product lists of the above-referenced companies, such as siRNA product #sc-76881 and sc-76882 and CRISPER products #sc-514859 from Santa Cruz Biotechnology, as well as multiple RNAi products and CRISPER products from Origene and GenScript (Piscataway, N.J.). It is to be noted that the term can further be used to refer to any combination of features described herein regarding KDM6A molecules. For example, any combination of sequence composition, percentage identify, sequence length, domain structure, functional activity, etc. can be used to describe an KDM6A molecule of the present invention.

The term "loss-of-function mutation" for KDM6A refers to any mutation in a KDM6A-related nucleic acid or protein that results in reduced or eliminated KDM6A protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of KDM6A. Such mutations reduce or eliminate KDM6A protein amounts and/or function by eliminating proper coding sequences required for proper KDM6A protein translation and/or coding for KDM6A proteins that are non-functional or have reduced function (e.g., deletion of enzymatic and/or structural domains, reduction in protein stability, alteration of subcellular localization, and the like). Such mutations are well-known in the art. In addition, a representative list describing a wide variety of structural mutations correlated with the functional result of reduced or eliminated KDM6A protein amounts and/or function is described in the Tables and the Examples.

A "kit" is any manufacture (e.g. a package or container) comprising at least one reagent, e.g. a probe or small molecule, for specifically detecting and/or affecting the expression of a marker of the present invention. The kit may be promoted, distributed, or sold as a unit for performing the methods of the present invention. The kit may comprise one or more reagents necessary to express a composition useful in the methods of the present invention. In certain embodiments, the kit may further comprise a reference standard, e.g., a nucleic acid encoding a protein that does not affect or regulate signaling pathways controlling cell growth, division, migration, survival or apoptosis. One skilled in the art can envision many such control proteins, including, but not limited to, common molecular tags (e.g., green fluorescent protein and beta-galactosidase), proteins not classified in any of pathway encompassing cell growth, division, migration, survival or apoptosis by GeneOntology reference, or ubiquitous housekeeping proteins. Reagents in the kit may be provided in individual containers or as mixtures of two or more reagents in a single container. In addition, instructional materials which describe the use of the compositions within the kit can be included.

The term "neoadjuvant therapy" refers to a treatment given before the primary treatment. Examples of neoadjuvant therapy can include chemotherapy, radiation therapy, and hormone therapy. For example, in treating breast cancer, neoadjuvant therapy can allows patients with large breast cancer to undergo breast-conserving surgery.

The "normal" level of expression of a biomarker is the level of expression of the biomarker in cells of a subject, e.g., a human patient, not afflicted with a cancer. An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

The term "pre-determined" biomarker amount and/or activity measurement(s) may be a biomarker amount and/or activity measurement(s) used to, by way of example only, evaluate a subject that may be selected for a particular treatment, evaluate a response to a treatment such as an anti-immune checkpoint inhibitor therapy, and/or evaluate the disease state. A pre-determined biomarker amount and/or activity measurement(s) may be determined in populations of patients with or without cancer. The pre-determined biomarker amount and/or activity measurement(s) can be a single number, equally applicable to every patient, or the pre-determined biomarker amount and/or activity measurement(s) can vary according to specific subpopulations of patients. Age, weight, height, and other factors of a subject may affect the pre-determined biomarker amount and/or activity measurement(s) of the individual. Furthermore, the pre-determined biomarker amount and/or activity can be determined for each subject individually. In one embodiment, the amounts determined and/or compared in a method described herein are based on absolute measurements. In another embodiment, the amounts determined and/or compared in a method described herein are based on relative measurements, such as ratios (e.g., serum biomarker normalized to the expression of a housekeeping or otherwise generally constant biomarker). The pre-determined biomarker amount and/or activity measurement(s) can be any suitable standard. For example, the pre-determined biomarker amount and/or activity measurement(s) can be obtained from the same or a different human for whom a patient selection is being assessed. In one embodiment, the pre-determined biomarker amount and/or activity measurement(s) can be obtained from a previous assessment of the same patient. In such a manner, the progress of the selection of the patient can be monitored over time. In addition, the control can be obtained from an assessment of another human or multiple humans, e.g., selected groups of humans, if the subject is a human. In such a manner, the extent of the selection of the human for whom selection is being assessed can be compared to suitable other humans, e.g., other humans who are in a similar situation to the human of interest, such as those suffering from similar or the same condition(s) and/or of the same ethnic group.

The term "predictive" includes the use of a biomarker nucleic acid and/or protein status, e.g., over- or under-activity, emergence, expression, growth, remission, recurrence or resistance of tumors before, during or after therapy, for determining the likelihood of response of a cancer to anti-immune checkpoint treatment (e.g., therapeutic antibodies against CTLA-4, PD-1, PD-L1, and the like). Such predictive use of the biomarker may be confirmed by, e.g., (1) increased or decreased copy number (e.g., by FISH, FISH plus SKY, single-molecule sequencing, e.g., as described in the art at least at *J. Biotechnol.*, 86:289-301, or qPCR), overexpression or underexpression of a biomarker nucleic acid (e.g., by ISH, Northern Blot, or qPCR), increased or decreased biomarker protein (e.g., by IHC), or increased or decreased activity, e.g., in more than about 5%, 6%, 7%, 8%, 9%, 10%, 11%, 12%, 13%, 14%, 15%, 20%, 25%, 30%, 40%, 50%, 60%, 70%, 80%, 90%, 95%, 100%, or more of assayed human cancers types or cancer samples; (2) its absolute or relatively modulated presence or absence in a biological sample, e.g., a sample containing tissue, whole blood, serum, plasma, buccal scrape, saliva, cerebrospinal fluid, urine, stool, or bone marrow, from a subject, e.g. a human, afflicted with cancer; (3) its absolute or relatively modulated presence or absence in clinical subset of patients with cancer (e.g., those responding to a particular immune checkpoint therapy or those developing resistance thereto).

The term "pre-malignant lesions" as described herein refers to a lesion that, while not cancerous, has potential for becoming cancerous. It also includes the term "pre-malignant disorders" or "potentially malignant disorders." In particular this refers to a benign, morphologically and/or histologically altered tissue that has a greater than normal risk of malignant transformation, and a disease or a patient's habit that does not necessarily alter the clinical appearance of local tissue but is associated with a greater than normal risk of precancerous lesion or cancer development in that tissue (leukoplakia, erythroplakia, erytroleukoplakia lichen planus (lichenoid reaction) and any lesion or an area which histological examination showed atypia of cells or dysplasia.

The terms "prevent," "preventing," "prevention," "prophylactic treatment," and the like refer to reducing the probability of developing a disease, disorder, or condition in a subject, who does not have, but is at risk of or susceptible to developing a disease, disorder, or condition.

The term "probe" refers to any molecule which is capable of selectively binding to a specifically intended target molecule, for example, a nucleotide transcript or protein encoded by or corresponding to a biomarker nucleic acid. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic molecules.

The term "prognosis" includes a prediction of the probable course and outcome of cancer or the likelihood of recovery from the disease. In some embodiments, the use of statistical algorithms provides a prognosis of cancer in an individual. For example, the prognosis can be surgery, development of a clinical subtype of cancer (e.g., solid tumors, such as lung cancer, melanoma, and renal cell carcinoma), development of one or more clinical factors, development of intestinal cancer, or recovery from the disease.

The term "response to immune checkpoint therapy" relates to any response of the hyperproliferative disorder (e.g., cancer) to an immune checkpoint therapy, such as immune checkpoint therapy, preferably to a change in tumor mass and/or volume after initiation of neoadjuvant or adjuvant chemotherapy. Hyperproliferative disorder response may be assessed, for example for efficacy or in a neoadjuvant or adjuvant situation, where the size of a tumor after systemic intervention can be compared to the initial size and dimensions as measured by CT, PET, mammogram, ultrasound or palpation. Responses may also be assessed by caliper measurement or pathological examination of the tumor after biopsy or surgical resection. Response may be recorded in a quantitative fashion like percentage change in tumor volume or in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of hyperproliferative disorder response may be done early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed. This is typically three months after initiation of neoadjuvant therapy. In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular cancer therapeutic regimen is at least 25%, 30%, 35%, 40%, 45%, 50%, 55%, 60%, 65%, 70%, 75%, 80%, 85%, or more. Additional criteria for evaluating the response to cancer therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence. For example, in order to determine appropriate threshold values, a particular cancer therapeutic regimen can be administered to a population of subjects and the outcome can be correlated to biomarker measurements that were determined prior to administration of any cancer therapy. The outcome measurement may be pathologic response to therapy given in the neoadjuvant setting. Alternatively, outcome measures, such as overall survival and disease-free survival can be monitored over a period of time for subjects following cancer therapy for whom biomarker measurement values are known. In certain embodiments, the doses administered are standard doses known in the art for cancer therapeutic agents. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of a cancer therapy can be determined using well-known methods in the art, such as those described in the Examples section.

The term "resistance" refers to an acquired or natural resistance of a cancer sample or a mammal to a cancer therapy (i.e., being nonresponsive to or having reduced or limited response to the therapeutic treatment), such as having a reduced response to a therapeutic treatment by 25% or more, for example, 30%, 40%, 50%, 60%, 70%, 80%, or more, to 2-fold, 3-fold, 4-fold, 5-fold, 10-fold, 15-fold, 20-fold or more. The reduction in response can be measured by comparing with the same cancer sample or mammal before the resistance is acquired, or by comparing with a different cancer sample or a mammal who is known to have no resistance to the therapeutic treatment. A typical acquired resistance to chemotherapy is called "multidrug resistance." The multidrug resistance can be mediated by P-glycoprotein or can be mediated by other mechanisms, or it can occur when a mammal is infected with a multi-drug-resistant microorganism or a combination of microorganisms. The determination of resistance to a therapeutic treatment is routine in the art and within the skill of an ordinarily skilled clinician, for example, can be measured by cell proliferative assays and cell death assays as described herein as "sensitizing." In some embodiments, the term "reverses resistance" means that the use of a second agent in combination with a primary cancer therapy (e.g., chemotherapeutic or radiation therapy) is able to produce a significant decrease in tumor volume at a level of statistical significance (e.g., p<0.05) when compared to tumor volume of untreated tumor in the circumstance where the primary cancer therapy (e.g., chemotherapeutic or radiation therapy) alone is unable to produce a statistically significant decrease in tumor volume compared to tumor volume of untreated tumor. This generally applies to tumor volume measurements made at a time when the untreated tumor is growing log rhythmically.

The terms "response" or "responsiveness" refers to an anti-cancer response, e.g. in the sense of reduction of tumor size or inhibiting tumor growth. The terms can also refer to an improved prognosis, for example, as reflected by an increased time to recurrence, which is the period to first recurrence censoring for second primary cancer as a first event or death without evidence of recurrence, or an increased overall survival, which is the period from treatment to death from any cause. To respond or to have a response means there is a beneficial endpoint attained when exposed to a stimulus. Alternatively, a negative or detrimental symptom is minimized, mitigated or attenuated on exposure to a stimulus. It will be appreciated that evaluating the likelihood that a tumor or subject will exhibit a favorable response is equivalent to evaluating the likelihood that the tumor or subject will not exhibit favorable response (i.e., will exhibit a lack of response or be non-responsive).

An "RNA interfering agent" as used herein, is defined as any agent which interferes with or inhibits expression of a target biomarker gene by RNA interference (RNAi). Such RNA interfering agents include, but are not limited to, nucleic acid molecules including RNA molecules which are homologous to the target biomarker gene of the present invention, or a fragment thereof, short interfering RNA (siRNA), and small molecules which interfere with or inhibit expression of a target biomarker nucleic acid by RNA interference (RNAi).

"RNA interference (RNAi)" is an evolutionarily conserved process whereby the expression or introduction of RNA of a sequence that is identical or highly similar to a target biomarker nucleic acid results in the sequence specific degradation or specific post-transcriptional gene silencing (PTGS) of messenger RNA (mRNA) transcribed from that targeted gene (see Coburn, G. and Cullen, B. (2002) *J. of Virology* 76(18):9225), thereby inhibiting expression of the target biomarker nucleic acid. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siR- NAs or RNA interfering agents, to inhibit or silence the expression of target biomarker nucleic acids. As used herein, "inhibition of target biomarker nucleic acid expression" or "inhibition of marker gene expression" includes any decrease in expression or protein activity or level of the target biomarker nucleic acid or protein encoded by the target biomarker nucleic acid. The decrease may be of at least 30%, 40%, 50%, 60%, 70%, 80%, 90%, 95% or 99% or more as compared to the expression of a target biomarker nucleic acid or the activity or level of the protein encoded by a target biomarker nucleic acid which has not been targeted by an RNA interfering agent.

The term "sample" used for detecting or determining the presence or level of at least one biomarker is typically whole blood, plasma, serum, saliva, urine, stool (e.g., feces), tears, and any other bodily fluid (e.g., as described above under the definition of "body fluids"), or a tissue sample (e.g., biopsy) such as a small intestine, colon sample, or surgical resection tissue. In certain instances, the method of the present invention further comprises obtaining the sample from the individual prior to detecting or determining the presence or level of at least one marker in the sample.

The term "sensitize" means to alter cancer cells or tumor cells in a way that allows for more effective treatment of the associated cancer with a cancer therapy (e.g., anti-immune checkpoint, chemotherapeutic, and/or radiation therapy). In some embodiments, normal cells are not affected to an extent that causes the normal cells to be unduly injured by the immune checkpoint therapy. An increased sensitivity or a reduced sensitivity to a therapeutic treatment is measured according to a known method in the art for the particular treatment and methods described herein below, including, but not limited to, cell proliferative assays (Tanigawa N, Kern D H, Kikasa Y, Morton D L, *Cancer Res* 1982; 42: 2159-2164), cell death assays (Weisenthal L M, Shoemaker R H, Marsden J A, Dill P L, Baker J A, Moran E M, *Cancer Res* 1984; 94: 161-173; Weisenthal L M, Lippman M E, Cancer Treat Rep 1985; 69: 615-632; Weisenthal L M, In: Kaspers G J L, Pieters R, Twentyman P R, Weisenthal L M, Veerman A J P, eds. Drug Resistance in Leukemia and Lymphoma. Langhorne, P A: Harwood Academic Publishers, 1993: 415-432; Weisenthal L M, Contrib Gynecol Obstet 1994; 19: 82-90). The sensitivity or resistance may also be measured in animal by measuring the tumor size reduction over a period of time, for example, 6 month for human and 4-6 weeks for mouse. A composition or a method sensitizes response to a therapeutic treatment if the increase in treatment sensitivity or the reduction in resistance is 25% or more, for example, 30%, 40%, 50%, 60%, 70%, 80%, or more, to 2-fold, 3-fold, 4-fold, 5-fold, 10-fold, 15-fold, 20-fold or more, compared to treatment sensitivity or resistance in the absence of such composition or method. The determination of sensitivity or resistance to a therapeutic treatment is routine in the art and within the skill of an ordinarily skilled clinician. It is to be understood that any method described herein for enhancing the efficacy of a cancer therapy can be equally applied to methods for sensitizing hyperproliferative or otherwise cancerous cells (e.g., resistant cells) to the cancer therapy.

The term "synergistic effect" refers to the combined effect of two or more anti-immune checkpoint agents can be greater than the sum of the separate effects of the anticancer agents alone.

"Short interfering RNA" (siRNA), also referred to herein as "small interfering RNA" is defined as an agent which functions to inhibit expression of a target biomarker nucleic acid, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) *RNA* 9:493-501 incorporated by reference herein).

RNA interfering agents, e.g., siRNA molecules, may be administered to a patient having or at risk for having cancer, to inhibit expression of a biomarker gene which is overexpressed in cancer and thereby treat, prevent, or inhibit cancer in the subject.

The term "subject" refers to any healthy animal, mammal or human, or any animal, mammal or human afflicted with a cancer, e.g., lung, ovarian, pancreatic, liver, breast, prostate, and colon carcinomas, as well as melanoma and multiple myeloma. The term "subject" is interchangeable with "patient."

The term "survival" includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g. time of diagnosis or start of treatment) and end point (e.g. death, recurrence or metastasis). In addition, criteria for efficacy of treatment can be expanded to include response to chemotherapy, probability of survival, probability of metastasis within a given time period, and probability of tumor recurrence.

The term "therapeutic effect" refers to a local or systemic effect in animals, particularly mammals, and more particularly humans, caused by a pharmacologically active substance. The term thus means any substance intended for use in the diagnosis, cure, mitigation, treatment or prevention of disease or in the enhancement of desirable physical or mental development and conditions in an animal or human. The phrase "therapeutically-effective amount" means that amount of such a substance that produces some desired local or systemic effect at a reasonable benefit/risk ratio applicable to any treatment. In certain embodiments, a therapeutically effective amount of a compound will depend on its therapeutic index, solubility, and the like. For example, certain compounds discovered by the methods of the present invention may be administered in a sufficient amount to produce a reasonable benefit/risk ratio applicable to such treatment.

The terms "therapeutically-effective amount" and "effective amount" as used herein means that amount of a compound, material, or composition comprising a compound of the present invention which is effective for producing some desired therapeutic effect in at least a sub-population of cells in an animal at a reasonable benefit/risk ratio applicable to any medical treatment. Toxicity and therapeutic efficacy of subject compounds may be determined by standard pharmaceutical procedures in cell cultures or experimental animals, e.g., for determining the $LD_{50}$ and the $ED_{50}$. Compositions that exhibit large therapeutic indices are preferred. In some embodiments, the $LD_{50}$ (lethal dosage) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more reduced for the agent relative to no administration of the agent. Similarly, the $ED_{50}$ (i.e., the concentration which achieves a half-maximal inhibition of symptoms) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. Also, Similarly, the $IC_{50}$ (i.e., the concentration which achieves half-maximal cytotoxic or cytostatic effect on cancer cells) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. In some embodiments, cancer cell growth in an assay can be inhibited by at least about 10%, 15%, 20%, 25%, 30%, 35%, 40%, 45%, 50%, 55%, 60%, 65%, 70%, 75%, 80%, 85%, 90%, 95%, or even 100%. In another embodiment, at least about a 10%, 15%, 20%, 25%, 30%, 35%, 40%, 45%, 50%, 55%, 60%, 65%, 70%, 75%, 80%, 85%, 90%, 95%, or even 100% decrease in a solid malignancy can be achieved.

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a biomarker nucleic acid and normal post-transcriptional processing (e.g. splicing), if any, of the RNA transcript, and reverse transcription of the RNA transcript.

As used herein, the term "unresponsiveness" includes refractivity of immune cells to stimulation, e.g., stimulation via an activating receptor or a cytokine. Unresponsiveness can occur, e.g., because of exposure to immunosuppressants or exposure to high doses of antigen. As used herein, the term "anergy" or "tolerance" includes refractivity to activating receptor-mediated stimulation. Such refractivity is generally antigen-specific and persists after exposure to the tolerizing antigen has ceased. For example, anergy in T cells (as opposed to unresponsiveness) is characterized by lack of cytokine production, e.g., IL-2. T cell anergy occurs when T cells are exposed to antigen and receive a first signal (a T cell receptor or CD-3 mediated signal) in the absence of a second signal (a costimulatory signal). Under these conditions, reexposure of the cells to the same antigen (even if reexposure occurs in the presence of a costimulatory polypeptide) results in failure to produce cytokines and, thus, failure to proliferate. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate IL-2 gene transcription induced by a heterologous promoter under the control of the 5' IL-2 gene enhancer or by a multimer of the AP1 sequence that can be found within the enhancer (Kang et al. (1992) *Science* 257:1134).

There is a known and definite correspondence between the amino acid sequence of a particular protein and the nucleotide sequences that can code for the protein, as defined by the genetic code (shown below). Likewise, there is a known and definite correspondence between the nucleotide sequence of a particular nucleic acid and the amino acid sequence encoded by that nucleic acid, as defined by the genetic code.

Genetic Code
Alanine (Ala, A) GCA, GCC, GCG, GCT
Arginine (Arg, R) AGA, ACG, CGA, CGC, CGG, CGT
Asparagine (Asn, N) AAC, AAT
Aspartic acid (Asp, D) GAC, GAT
Cysteine (Cys, C) TGC, TGT
Glutamic acid (Glu, E) GAA, GAG
Glutamine (Gln, Q) CAA, CAG
Glycine (Gly, G) GGA, GGC, GGG, GGT
Histidine (His, H) CAC, CAT
Isoleucine (Ile, I) ATA, ATC, ATT
Leucine (Leu, L) CTA, CTC, CTG, CTT, TTA, TTG
Lysine (Lys, K) AAA, AAG
Methionine (Met, M) ATG
Phenylalanine (Phe, F) TTC, TTT
Proline (Pro, P) CCA, CCC, CCG, CCT
Serine (Ser, S) AGC, AGT, TCA, TCC, TCG, TCT
Threonine (Thr, T) ACA, ACC, ACG, ACT
Tryptophan (Trp, W) TGG
Tyrosine (Tyr, Y) TAC, TAT
Valine (Val, V) GTA, GTC, GTG, GTT
Termination signal (end) TAA, TAG, TGA An important and well known feature of the genetic code is its redundancy, whereby, for most of the amino acids used to make proteins, more than one coding nucleotide triplet may be employed (illustrated above). Therefore, a number of different nucleotide sequences may code for a given amino acid sequence. Such nucleotide sequences are considered functionally equivalent since they result in the production of the same amino acid sequence in all organisms (although certain organisms may translate some sequences more efficiently than they do others). Moreover, occasionally, a methylated variant of a purine or pyrimidine may be found in a given nucleotide sequence. Such methylations do not affect the coding relationship between the trinucleotide codon and the corresponding amino acid.

In view of the foregoing, the nucleotide sequence of a DNA or RNA encoding a biomarker nucleic acid (or any portion thereof) can be used to derive the polypeptide amino acid sequence, using the genetic code to translate the DNA or RNA into an amino acid sequence. Likewise, for polypeptide amino acid sequence, corresponding nucleotide sequences that can encode the polypeptide can be deduced from the genetic code (which, because of its redundancy, will produce multiple nucleic acid sequences for any given amino acid sequence). Thus, description and/or disclosure herein of a nucleotide sequence which encodes a polypeptide should be considered to also include description and/or disclosure of the amino acid sequence encoded by the nucleotide sequence. Similarly, description and/or disclosure of a polypeptide amino acid sequence herein should be considered to also include description and/or disclosure of all possible nucleotide sequences that can encode the amino acid sequence.

Finally, nucleic acid and amino acid sequence information for the loci and biomarkers of the present invention (e.g., biomarkers listed in Table 1) are well known in the art and readily available on publicly available databases, such as the National Center for Biotechnology Information (NCBI). For example, exemplary nucleic acid and amino acid sequences derived from publicly available sequence databases are provided below.

TABLE 1

```
SEQ ID NO: 1 Human PBRM1 Transcript Variant 1 cDNA Sequence
(NM_018313.4)
   1 gcggccgcgg ccggaggagc aatagcagca gccgtggcgg ccacggggcg gggcgcggcg
  61 gtcggtgacc gcggccgggg ctgcaggcgg cggagcggct ggaagttgga ttccatgggt
 121 tccaagagaa gaagagctac ctccccttcc agcagtgtca gcggggactt tgatgatggg
 181 caccattctg tgtcaacacc aggcccaagc aggaaaagga ggagactttc caatcttcca
 241 actgtagatc ctattgccgt gtgccatgaa ctctataata ccatccgaga ctataaggat
 301 gaacagggca gacttctctg tgagctcttc attagggcac caaagcgaag aaatcaacca
 361 gactattatg aagtggtttc tcagcccatt gacttgatga aaatccaaca gaaactaaaa
 421 atggaagagt atgatgatgt taatttgctg actgctgact tccagcttct ttttaacaat
 481 gcaaagtcct attataagcc agattctcct gaatataaag ccgcttgcaa actctgggat
 541 ttgtaccttc gaacaagaaa tgagtttgtt cagaaaggag aagcagatga cgaagatgat
 601 gatgaagatg ggcaagacaa tcagggcaca gtgactgaag gatcttctcc agcttacttg
 661 aaggagatcc tggagcagct tcttgaagcc atagttgtag ctacaaatcc atcaggacgt
 721 ctcattagcg aacttttca gaaactgcct tctaaagtgc aatatccaga ttattatgca
 781 ataattaagg agcctataga tctcaagacc attgcccaga ggatacagaa tggaagctac
 841 aaaagtattc atgcaatggc caaagatata gatctcctcg caaaaaatgc caaaacttat
 901 aatgagcctg gctctcaagt attcaaggat gcaaattcaa ttaaaaaaat attttatatg
 961 aaaaaggctg aaattgaaca tcatgaaatg gctaagtcaa gtcttcgaat gaggactcca
1021 tccaacttgg ctgcagccag actgacaggt ccttcacaca gtaaaggcag ccttggtgaa
1081 gagagaaatc ccactagcaa gtattaccgt aataaaagag cagtacaagg aggtcgttta
1141 tcagcaatta caatggcact tcaatatggc tcagaaagtg aagaagatgc tgctttagct
1201 gctgcacgct atgaagaggg agagtcagaa gcagaaagca tcacttcctt tatggatgtt
1261 tcaaatcctt tttatcagct ttatgacaca gttaggagtt gtcggaataa ccaagggcag
1321 ctaatagctg aaccttttta ccatttgcct tcaaagaaaa ataccctga ttattaccag
1381 caaattaaaa tgcccatatc actacaacag atccgaacaa aactgaagaa tcaagaatat
1441 gaaactttag atcatttgga gtgtgatctg aatttaatgt ttgaaaatgc caaacgctat
1501 aatgtgccca attcagccat ctacaagcga gttctaaaat tgcagcaagt tatgcaggca
1561 aagaagaaag agcttgccag gagagacgat atcgaggacg gagacagcat gatctcttca
1621 gccacctctg atactggtag tgccaaaaga aaagtaaaa agaacataag aaagcagcga
1681 atgaaaatct tattcaatgt tgttcttgaa gctcgagagc caggttcagg cagaagactt
1741 tgtgacctat ttatggttaa accatccaaa aaggactatc ctgattatta taaaatcatc
1801 ttggagccaa tggacttgaa aataattgag cataacatcc gcaatgacaa atatgctggt
1861 gaagagggaa tgatagaaga catgaagctg atgttccgga atgccaggca ctataatgag
1921 gagggctccc aggtttataa tgatgcacat atcctggaga agttactcaa ggagaaaagg
1981 aaagagctgg gcccactgcc tgatgatgat gacatggctt ctcccaaact caagctgagt
2041 aggaagagtg gcatttctcc taaaaaatca aaatacatga ctccaatgca gcagaaacta
```

TABLE 1-continued

```
2101  aatgaggtct atgaagctgt aaagaactat actgataaga ggggtcgccg cctcagtgcc
2161  atatttctga ggcttccctc tagatctgag ttgcctgact actatctgac tattaaaaag
2221  cccatggaca tggaaaaaat tcgaagtcac atgatggcca acaagtacca agatattgac
2281  tctatggttg aggactttgt catgatgttt aataatgcct gtacatacaa tgagccggag
2341  tctttgatct acaaagatgc tcttgttcta cacaaagtcc tgcttgaaac acgcagagac
2401  ctggagggag atgaggactc tcatgtccca aatgtgactt tgctgattca agagcttatc
2461  cacaatcttt ttgtgtcagt catgagtcat caggatgatg agggaagatg ctacagcgat
2521  tctttagcag aaattcctgc tgtggatccc aactttccta acaaaccacc ccttacattt
2581  gacataatta ggaagaatgt tgaaaataat cgctaccgtc ggcttgattt atttcaagag
2641  catatgtttg aagtattgga acgagcaaga aggatgaatc ggacagattc agaaatatat
2701  gaagatgcag tagaacttca gcagtttttt attaaaattc gtgatgaact ctgcaaaaat
2761  ggagagattc ttctttcacc ggcactcagc tataccacaa acatttgca taatgatgtg
2821  gagaaagaga gaaggaaaa attgccaaaa gaaatagagg aagataaact aaaacgagaa
2881  gaagaaaaaa gagaagctga aaagagtgaa gattcctctg gtgctgcagg cctctcaggc
2941  ttacatcgca catacagcca ggactgtagc tttaaaaaca gcatgtacca tgttggagat
3001  tacgtctatg tggaacctgc agaggccaac ctacaaccac atatcgtctg tattgaaaga
3061  ctgtgggagg attcagctga aaagaagtt tttaagagtg actattacaa caaagttcca
3121  gttagtaaaa ttctaggcaa gtgtgtggtc atgtttgtca aggaatactt taagttatgc
3181  ccagaaaact tccgagatga ggatgttttt gtctgtgaat cacggtattc tgccaaaacc
3241  aaatctttta agaaaattaa actgtggacc atgcccatca gctcagtcag gtttgtccct
3301  cgggatgtgc ctctgcctgt ggttcgcgtg gcctctgtat ttgcaaatgc agataaaggt
3361  gatgatgaga agaatacaga caactcagag gacagtcgag ctgaagacaa tttttaacttg
3421  gaaaaggaaa aagaagatgt ccctgtggaa atgtccaatg gtgaaccagg ttgccactac
3481  tttgagcagc tccattacaa tgacatgtgg ctgaaggttg gcgactgtgt cttcatcaag
3541  tcccatggcc tggtgcgtcc tcgtgtgggc agaattgaaa aagtatgggt cgagatgga
3601  gctgcatatt tttatggccc catcttcatt cacccagaag aaacagagca tgagcccaca
3661  aaaatgttct acaaaaaaga agtatttctg agtaatctgg aagaaacctg ccccatgaca
3721  tgtattctcg gaaagtgtgc tgtgttgtca ttcaaggact tcctctcctg caggccaact
3781  gaaataccag aaaatgacat tctgctttgt gagagccgct acaatgagag cgacaagcag
3841  atgaagaaat tcaaaggatt gaagaggttt tcactctctg ctaaagtggt agatgatgaa
3901  atttactact tcagaaaacc aattgttcct cagaaggagc catcacccttt gctggaaaag
3961  aagatccagt tgctagaagc taaatttgcc gagttagaag gtggagatga tgatattgaa
4021  gagatgggag aagaagatag tgagtctacc ccaaagtctg ccaaaggcag tgcaaagaag
4081  gaaggctcca acggaaaaat caacatgagt ggctacatcc tgttcagcag tgagatgagg
4141  gctgtgatta aggcccaaca cccagactac tctttcgggg agctcagccg cctggtgggg
4201  acagaatgga gaaatcttga gacagccaag aaagcagaat atgaaggcat gatgggtggc
4261  tatccgccag gccttccacc tttgcagggc ccagttgatg gccttgttag catgggcagc
4321  atgcagccac ttcaccctgg ggggcctcca ccccaccatc ttccgccagg tgtgcctggc
4381  ctcccgggca tcccaccacc gggtgtgatg aaccaaggag tggcccctat ggtagggact
4441  ccagcaccag gtggaagtcc atatggacaa caggtgggag ttttgggggcc tccagggcag
```

TABLE 1-continued

```
4501  caggcaccac ctccatatcc cggcccacat ccagctggac ccctgtcat  acagcagcca
4561  acaacaccca tgtttgtagc tcccccacca aagacccagc ggcttcttca ctcagaggcc
4621  tacctgaaat acattgaagg actcagtgcg gagtccaaca gcattagcaa gtgggatcag
4681  acactggcag ctcgaagacg cgacgtccat ttgtcgaaag aacaggagag ccgcctaccc
4741  tctcactggc tgaaaagcaa agggggccac accaccatgg cagatgccct ctggcgcctt
4801  cgagatttga tgctccggga caccctcaac attcgccaag catacaacct agaaaatgtt
4861  taatcacatc attacgtttc ttttatatag aagcataaag agttgtggat cagtagccat
4921  tttagttact gggggtgggg ggaaggaaca aaggaggata attttttattg cattttactg
4981  tacatcacaa ggccatttt atatacggac acttttaata agctatttca atttgtttgt
5041  tatattaagt tgactttatc aaatacacaa agatttttt gcatatgttt ccttcgttta
5101  aaaccagttt cataattggt tgtatatgta gacttggagt tttatctttt tacttgttgc
5161  catggaactg aaaccattag aggttttttgt cttggcttgg ggttttttgtt ttcttggttt
5221  tgggtttttt tatatatata tataaaagaa caaaatgaaa aaaaacacac acacacaaga
5281  gtttacagat tagtttaaat tgataatgaa atgtgaagtt tgtcctagtt tacatcttag
5341  agagggagt atacttgtgt ttgtttcatg tgcctgaata tcttaagcca ctttctgcaa
5401  aagctgtttc ttacagatga agtgctttct ttgaaaggtg gttatttagg ttttagatgt
5461  ttaatagaca cagcacattt gctctattaa ctcagaggct cactacagaa atatgtaatc
5521  agtgctgtgc atctgtctgc agctaatgta cctcctggac accaggaggg gaaaaagcac
5581  tttttcaatt gtgctgagtt agacatctgt gagttagact atggtgtcag tgattttgc
5641  agaacacgtg cacaaccctg aggtatgttt aatctaggca ggtacgttta aggatatttt
5701  gatctattta taatgaattc acaatttatg cctataaatt tcagatgatt taaaatttta
5761  aacctgttac attgaaaaac attgaagttc gtcttgaaga aagcattaag gtatgcatgg
5821  aggtgattta ttttttaaaca taacacctaa cctaacatgg gtaagagagt atggaactag
5881  atatgagctg tataagaagc ataattgtga acaagtagat tgattgcctt catatacaag
5941  tatgttttag tattccttat ttccttatta tcagatgtat ttttcttttt aagtttcaat
6001  gttgttataa ttctcaacca gaaatttaat actttctaaa atatttttta aatttagctt
6061  gtgcttttga attacaggag aagggaatca taatttaata aaacgcttac tagaaagacc
6121  attacagatc ccaaacactt gggtttggtg accctgtctt tcttatatga ccctacaata
6181  aacatttgaa ggcagcatag gatggcagca agtaggaaca ttgtttcact tggcggcatg
6241  ttttttgaaac ctgctttata gtaactgggt gattgccatt gtggtagagc ttccactgct
6301  gtttataatc tgagagagtt aatctcagag gatgcttttt tccttttaat ctgctatgaa
6361  tcagtaccca gatgtttaat tactgtactt attaaatcat gagggcaaaa gagtgtagaa
6421  tggaaaaaag tctcttgtat ctagatactt taaatatggg aggcccttta acttaattgc
6481  ctttagtcaa ccactggatt tgaatttgca tcaagtattt taaataatat tgaatttaaa
6541  aaaatgtatt gcagtagtgt gtcagtacct tattgttaaa gtgagtcaga taaatcttca
6601  attcctggct atttgggcaa ttgaatcatc atggactgta taatgcaatc agattatttt
6661  gtttctagac atccttgaat tacaccaaag aacatgaaat ttagttgtgg ttaaattatt
6721  tatttatttc atgcattcat tttatttccc ttaaggtctg atgagagactt ctttggggag
6781  cctctaaaaa aatttttcac tgggggccac gtgggtcatt agaagccaga gctctcctcc
6841  aggctccttc ccagtgccta gaggtgctat aggaaacata gatccagcca ggggcttccc
```

TABLE 1-continued

```
6901  taaagcagtg cagcaccggc ccagggcatc actagacagg ccctaattaa gttttttta
6961  aaaagcctgt gtatttattt tagaatcatg tttttctgta tattaacttg ggggatatcg
7021  ttaatattta ggatataaga tttgaggtca gccatcttca aaaagaaaa aaaaattgac
7081  tcaagaaagt acaagtaaac tatacacctt tttttcataa gttttaggaa ctgtagtaat
7141  gtggcttaga aagtataatg gcctaaatgt tttcaaaatg taagttcctg tggagaagaa
7201  ttgtttatat tgcaaacggg gggactgagg ggaacctgta ggtttaaaac agtatgtttg
7261  tcagccaact gatttaaaag gcctttaact gttttggttg ttgtttttttt tttaagccac
7321  tctcccctc ctatgaggaa gaattgagag gggcacctat ttctgtaaaa tccccaaatt
7381  ggtgttgatg attttgagct tgaatgtttt catacctgat taaaacttgg tttattctaa
7441  tttctgtatc atatcatctg aggtttacgt ggtaactagt cttataacat gtatgtatct
7501  ttttttgtt gttcatctaa agctttttaa tccaaataaa tacagagttt gcaaagtgat
7561  ttggattaac caggaaaaaa aaaaaaaaaa aa
```

SEQ ID NO: 2 Human PBRM1 Variant 1 Amino Acid Sequence (NP_060783.3)

```
   1  mgskrrrats psssysgdfd dghhsystpg psrkrrrlsn lptvdpiavc helyntirdy
  61  kdeggrllce lfirapkrrn qpdyyevvsq pidlmkiqqk lkmeeyddvn lltadfqllf
 121  nnaksyykpd speykaackl wdlylrtrne fvqkgeadde dddedgqdnq gtvtegsspa
 181  ylkeileggl eaivvatnps grliselfqk lpskvqypdy yaiikepidl ktiagrigng
 241  syksihamak didllaknak tynepgsqvf kdansikkif ymkkaeiehh emakssslrmr
 301  tpsnlaaarl tgpshskgsl geernptsky yrnkravqgg rlsaitmalq ygseseedaa
 361  laaaryeege seaesitsfm dvsnpfyqly dtvrscrnnq gqliaepfyh lpskkkypdy
 421  yggikmpisl gqirtklknq eyetldhlec dlnlmfenak rynvpnsaiy krvlklqqvm
 481  qakkkelarr ddiedgdsmi ssatsdtgsa krkskknirk qrmkilfnvv learepgsgr
 541  rlcdlfmvkp skkdypdyyk iilepmdlki iehnirndky ageegmiedm klmfrnarhy
 601  neegsqvynd ahilekllke krkelgplpd dddmaspklk lsrksgispk kskymtpmqg
 661  klnevyeavk nytdkrgrrl saiflrlpsr selpdyylti kkpmdmekir shmmankyqd
 721  idsmvedfvm mfnnactyne pesliykdal vlhkvlletr rdlegdedsh vpnvtlliqe
 781  lihnlfvsvm shqddegrcy sdslaeipav dpnfpnkppl tfdiirknve nnryrrldlf
 841  qehmfevler arrmnnrtdse iyedavelqg ffikirdelc kngeillspa lsyttkhlhn
 901  dvekerkekl pkeieedklk reeekreaek sedssgaagl sglhrtysqd csfknsmyhv
 961  gdyvyvepae anlqphivci erlwedsaek evfksdyynk vpvskilgkc vvmfvkeyfk
1021  lcpenfrded vfvcesrysa ktksfkkikl wtmpissvrf vprdvplpvv rvasvfanad
1081  kgddekntdn sedsraednf nlekekedvp vemsngepgc hyfeqlhynd mwlkvgdcvf
1141  ikshglvrpr vgriekvwvr dgaayfygpi fihpeetehe ptkmfykkev flsnleetcp
1201  mtcilgkcav lsfkdflscr pteipendil lcesrynesd kqmkkfkglk rfslsakvvd
1261  deiyyfrkpi vpqkepspll ekkiqlleak faeleggddd ieemgeedse stpksakgsa
1321  kkegskrkin msgyilfsse mravikaqhp dysfgelsrl vgtewrnlet akkaeyegmm
1381  ggyppglppl qgpvdglvsm gsmqplhpgg ppphhlppgv pglpgipppg vmnqgvapmv
1441  gtpapggspy gqvgvlgpp gqqapppypg phpagppviq qpttpmfvap ppktgrllhs
1501  eaylkyiegl saesnsiskw dqtlaarrrd vhlskeqesr lpshwlkskg ahttmadalw
1561  rlrdlmlrdt lnirqaynle nv
```

TABLE 1-continued

SEQ ID NO: 3 Human PBRM1 Transcript Variant 2 cDNA Sequence
(NM_181042.4)

```
   1 gcggccgggg ctgcaggcgg cggagcggct ggcttgccaa cacttggtgt cacatgtgag
  61 cctcccacat gtattcactc tccattccag ctctgtgatt gaactctgct cttattgact
 121 aggggggcagt tgggcaggca tgcctcattc ctggaattga cagtcattcc taataagttg
 181 gattccatgg gttccaagag aagaagagct acctcccctt ccagcagtgt cagcggggac
 241 tttgatgatg ggcaccattc tgtgtcaaca ccaggcccaa gcaggaaaag gaggagactt
 301 tccaatcttc caactgtaga tcctattgcc gtgtgccatg aactctataa taccatccga
 361 gactataagg atgaacaggg cagacttctc tgtgagctct tcattagggc accaaagcga
 421 agaaatcaac cagactatta tgaagtggtt tctcagccca ttgacttgat gaaaatccaa
 481 cagaaactaa aaatggaaga gtatgatgat gttaatttgc tgactgctga cttccagctt
 541 cttttttaaca atgcaaagtc ctattataag ccagattctc ctgaatataa agccgcttgc
 601 aaactctggg atttgtacct tcgaacaaga aatgagtttg ttcagaaagg agaagcagat
 661 gacgaagatg atgatgaaga tgggcaagac aatcagggca cagtgactga aggatcttct
 721 ccagcttact tgaaggagat cctggagcag cttcttgaag ccatagttgt agctacaaat
 781 ccatcaggac gtctcattag cgaactttt cagaaactgc cttctaaagt gcaatatcca
 841 gattattatg caataattaa ggagcctata gatctcaaga ccattgccca gaggatacag
 901 aatggaagct acaaaagtat tcatgcaatg gccaaagata tagatctcct cgcaaaaaat
 961 gccaaaactt ataatgagcc tggctctcaa gtattcaagg atgcaaattc aattaaaaaa
1021 atattttata tgaaaaaggc tgaaattgaa catcatgaaa tggctaagtc aagtcttcga
1081 atgaggactc catccaactt ggctgcagcc agactgacag gtccttcaca cagtaaaggc
1141 agccttggtg aagagagaaa tcccactagc aagtattacc gtaataaaag agcagtacaa
1201 ggaggtcgtt tatcagcaat tacaatggca cttcaatatg gctcagaaag tgaagaagat
1261 gctgctttag ctgctgcacg ctatgaagag ggagagtcag aagcagaaag catcacttcc
1321 tttatggatg tttcaaatcc ttttttatcag cttttatgaca cagttaggag ttgtcggaat
1381 aaccaagggc agctaatagc tgaaccttt taccatttgc cttcaaagaa aaaatacccct
1441 gattattacc agcaaattaa aatgcccata tcactacaac agatccgaac aaaactgaag
1501 aatcaagaat atgaaacttt agatcatttg gagtgtgatc tgaatttaat gtttgaaaat
1561 gccaaacgct ataatgtgcc caattcagcc atctacaagc gagttctaaa attgcagcaa
1621 gttatgcagg caaagaagaa agagcttgcc aggagagacg atatcgagga cggagacagc
1681 atgatctctt cagccacctc tgatactggt agtgccaaaa gaaaagtaa aagaacata
1741 agaaagcagc gaatgaaaat cttattcaat gttgttcttg aagctcgaga gccaggttca
1801 ggcagaagac tttgtgacct atttatggtt aaaccatcca aaaaggacta tcctgattat
1861 tataaaatca tcttggagcc aatggacttg aaaataattg agcataacat ccgcaatgac
1921 aaatatgctg gtgaagaggg aatgatagaa gacatgaagc tgatgttccg gaatgccagg
1981 cactataatg aggagggctc ccaggtttat aatgatgcac atatcctgga gaagttactc
2041 aaggagaaaa ggaaagagct gggcccactg cctgatgatg atgacatggc ttctccccaaa
2101 ctcaagctga gtaggaagag tggcattct cctaaaaaat caaaatacat gactccaatg
2161 cagcagaaac taatgaggt ctatgaagct gtaaagaact atactgataa gaggggtcgc
2221 cgcctcagtg ccatatttct gaggcttccc tctagatctg agttgcctga ctactatctg
2281 actattaaaa agcccatgga catggaaaaa attcgaagtc acatgatggc caacaagtac
```

TABLE 1-continued

```
2341  caagatattg actctatggt tgaggacttt gtcatgatgt ttaataatgc ctgtacatac
2401  aatgagccgg agtctttgat ctacaaagat gctcttgttc tacacaaagt cctgcttgaa
2461  acacgcagag acctggaggg agatgaggac tctcatgtcc caaatgtgac tttgctgatt
2521  caagagctta tccacaatct ttttgtgtca gtcatgagtc atcaggatga tgagggaaga
2581  tgctacagcg attctttagc agaaattcct gctgtggatc ccaactttcc taacaaacca
2641  ccccttacat ttgacataat taggaagaat gttgaaaata atcgctaccg tcggcttgat
2701  ttatttcaag agcatatgtt tgaagtattg aacgagcaa gaaggatgaa tcggacagat
2761  tcagaaatat atgaagatgc agtagaactt cagcagtttt ttattaaaat tcgtgatgaa
2821  ctctgcaaaa atggagagat tcttctttca ccggcactca gctataccac aaaacatttg
2881  cataatgatg tggagaaaga gagaaaggaa aaattgccaa agaaaataga ggaagataaa
2941  ctaaaacgag aagaagaaaa aagagaagct gaaaagagtg aagattcctc tggtgctgca
3001  ggcctctcag gcttacatcg cacatacagc caggactgta gctttaaaaa cagcatgtac
3061  catgttggag attacgtcta tgtggaacct gcagaggcca acctacaacc acatatcgtc
3121  tgtattgaaa gactgtggga ggattcagct ggtgaaaaat ggttgtatgg ctgttggttt
3181  taccgaccaa atgaaacatt ccacctggct acacgaaaat ttctagaaaa agaagttttt
3241  aagagtgact attacaacaa agttccagtt agtaaaattc taggcaagtg tgtggtcatg
3301  tttgtcaagg aatactttaa gttatgccca gaaaacttcc gagatgagga tgttttttgtc
3361  tgtgaatcac ggtattctgc caaaaccaaa tcttttaaga aaattaaact gtggaccatg
3421  cccatcagct cagtcaggtt tgtccctcgg gatgtgcctc tgcctgtggt tcgcgtggcc
3481  tctgtatttg caaatgcaga taaaggtgat gatgagaaga atacagacaa ctcagaggac
3541  agtcgagctg aagacaattt taacttggaa aaggaaaaag aagatgtccc tgtggaaatg
3601  tccaatggtg aaccaggttg ccactacttt gagcagctcc attacaatga catgtggctg
3661  aaggttggcg actgtgtctt catcaagtcc catggcctgg tgcgtcctcg tgtgggcaga
3721  attgaaaaag tatgggttcg agatggagct gcatattttt atggccccat cttcattcac
3781  ccagaagaaa cagagcatga gcccacaaaa atgttctaca aaaagaagt atttctgagt
3841  aatctggaag aaacctgccc catgacatgt attctcggaa agtgtgctgt gttgtcattc
3901  aaggacttcc tctcctgcag gccaactgaa ataccagaaa atgacattct gctttgtgag
3961  agccgctaca atgagagcga caagcagatg aagaaattca aaggattgaa gaggttttca
4021  ctctctgcta aagtggtaga tgatgaaatt tactacttca gaaaaccaat tgttcctcag
4081  aaggagccat caccttttgct ggaaaagaag atccagttgc tagaagctaa atttgccgag
4141  ttagaaggtg gagatgatga tattgaaagag atgggagaag aagatagtga ggtcattgaa
4201  cctccttctc tacctcagct tcagaccccc ctggccagtg agctggacct catgccctac
4261  acaccccac agtctacccc aaagtctgcc aaaggcagtg caaagaagga aggctccaaa
4321  cggaaaatca acatgagtgg ctacatcctg ttcagcagtg agatgagggc tgtgattaag
4381  gcccaacacc cagactactc tttcgggag ctcagccgcc tggtggggac agaatggaga
4441  aatcttgaga cagccaagaa agcagaatat gaaggtgtga tgaaccaagg agtggcccct
4501  atggtaggga ctccagcacc aggtggaagt ccatatggac aacaggtggg agttttgggg
4561  cctccagggc agcaggcacc acctccatat cccggcccac atccagctgg accccctgtc
4621  atacagcagc caacaacacc catgtttgta gctcccccac caaagaccca gcggcttctt
4681  cactcagagg cctacctgaa atacattgaa ggactcagtg cggagtccaa cagcattagc
```

TABLE 1-continued

```
4741  aagtgggatc agacactggc agctcgaaga cgcgacgtcc atttgtcgaa agaacaggag
4801  agccgcctac cctctcactg gctgaaaagc aaaggggccc acaccaccat ggcagatgcc
4861  ctctggcgcc ttcgagattt gatgctccgg gacaccctca acattcgcca agcatacaac
4921  ctagaaaatg tttaatcaca tcattacgtt tcttttatat agaagcataa agagttgtgg
4981  atcagtagcc attttagtta ctgggggtgg ggggaaggaa caaaggagga taattttat
5041  tgcattttac tgtacatcac aaggccattt ttatatacgg acacttttaa taagctattt
5101  caatttgttt gttatattaa gttgacttta tcaaatacac aaagattttt ttgcatatgt
5161  ttccttcgtt taaaaccagt ttcataattg gttgtatatg tagacttgga gttttatctt
5221  tttacttgtt gccatggaac tgaaaccatt agaggttttt gtcttggctt ggggttttg
5281  ttttcttggt tttgggtttt tttatatata tatataaaag aacaaaatga aaaaaaacac
5341  acacacacaa gagtttacag attagtttaa attgataatg aaatgtgaag tttgtcctag
5401  tttacatctt agagagggga gtatacttgt gtttgtttca tgtgcctgaa tatcttaagc
5461  cactttctgc aaaagctgtt tcttacagat gaagtgcttt ctttgaaagg tggttattta
5521  ggttttagat gtttaataga cacagcacat ttgctctatt aactcagagg ctcactacag
5581  aaatatgtaa tcagtgctgt gcatctgtct gcagctaatg tacctcctgg acaccaggag
5641  gggaaaaagc acttttcaa ttgtgctgag ttagacatct gtgagttaga ctatggtgtc
5701  agtgattttt gcagaacacg tgcacaaccc tgaggtatgt ttaatctagg caggtacgtt
5761  taaggatatt ttgatctatt tataatgaat tcacaattta tgcctataaa tttcagatga
5821  tttaaaattt taaacctgtt acattgaaaa acattgaagt tcgtcttgaa gaaagcatta
5881  aggtatgcat ggaggtgatt tattttaaa cataacacct aacctaacat gggtaagaga
5941  gtatggaact agatatgagc tgtataagaa gcataattgt gaacaagtag attgattgcc
6001  ttcatataca agtatgtttt agtattcctt atttccttat tatcagatgt attttttctt
6061  ttaagtttca atgttgttat aattctcaac cagaaattta atactttcta aaatattttt
6121  taaatttagc ttgtgctttt gaattacagg agaagggaat cataatttaa taaaacgctt
6181  actagaaaga ccattacaga tcccaaacac ttgggtttgg tgaccctgtc tttcttatat
6241  gaccctacaa taaacatttg aaggcagcat aggatggcag acagtaggaa cattgtttca
6301  cttggcggca tgttttgaa acctgcttta tagtaactgg gtgattgcca ttgtggtaga
6361  gcttccactg ctgtttataa tctgagagag ttaatctcag aggatgcttt tttccttta
6421  atctgctatg aatcagtacc cagatgttta attactgtac ttattaaatc atgagggcaa
6481  aagagtgtag aatggaaaaa agtctcttgt atctagatac tttaaatatg ggaggcccctt
6541  taacttaatt gcctttagtc aaccactgga tttgaatttg catcaagtat tttaaataat
6601  attgaattta aaaaaatgta ttgcagtagt gtgtcagtac cttattgtta aagtgagtca
6661  gataaatctt caattcctgg ctatttgggc aattgaatca tcatggactg tataatgcaa
6721  tcagattatt ttgtttctag acatccttga attacaccaa agaacatgaa atttagttgt
6781  ggttaaatta tttatttatt tcatgcattc atttatttc ccttaaggtc tggatgagac
6841  ttctttgggg agcctctaaa aaaattttc actgggggcc acgtgggtca ttagaagcca
6901  gagctctcct ccaggctcct tcccagtgcc tagaggtgct ataggaaaca tagatccagc
6961  caggggcttc cctaaagcag tgcagcaccg gcccagggca tcactagaca ggccctaatt
7021  aagttttttt taaaaagcct gtgtatttat tttagaatca tgttttctg tatattaact
7081  tgggggatat cgttaatatt taggatataa gatttgaggt cagccatctt caaaaaagaa
```

TABLE 1-continued

```
7141  aaaaaaattg actcaagaaa gtacaagtaa actatacacc ttttttttcat aagttttagg
7201  aactgtagta atgtggctta gaaagtataa tggcctaaat gttttcaaaa tgtaagttcc
7261  tgtggagaag aattgtttat attgcaaacg gggggactga ggggaacctg taggtttaaa
7321  acagtatgtt tgtcagccaa ctgatttaaa aggcctttaa ctgttttggt tgttgttttt
7381  tttttaagcc actctcccct tcctatgagg aagaattgag aggggcacct atttctgtaa
7441  aatccccaaa ttggtgttga tgattttgag cttgaatgtt ttcatacctg attaaaactt
7501  ggtttattct aatttctgta tcatatcatc tgaggtttac gtggtaacta gtcttataac
7561  atgtatgtat cttttttttg ttgttcatct aaagcttttt aatccaaat
```

SEQ ID NO: 4 Human PBRM1 Variant 2 Amino Acid Sequence (NP_851385.1)
```
   1  mgskrrrats psssysgdfd dghhsystpg psrkrrrlsn lptvdpiavc helyntirdy
  61  kdeqgrllce lfirapkrrn qpdyyevvsq pidlmkiqqk lkmeeyddvn lltadfqllf
 121  nnaksyykpd speykaackl wdlylrtrne fvqkgeadde dddedgqdnq gtvtegsspa
 181  ylkeilegll eaivvatnps grliselfqk lpskvqypdy yaiikepidl ktiagrigng
 241  syksihamak didllaknak tynepgsqvf kdansikkif ymkkaeiehh emaksslrmr
 301  tpsnlaaarl tgpshskgsl geernptsky yrnkravqgg rlsaitmalq ygseseedaa
 361  laaaryeege seaesitsfm dvsnpfyqly dtvrscrnnq gqliaepfyh lpskkkypdy
 421  yggikmpisl gqirtklknq eyetldhlec dlnlmfenak rynvpnsaiy krvlklqqvm
 481  qakkkelarr ddiedgdsmi ssatsdtgsa krkskknirk qrmkilfnvv learepgsgr
 541  rlcdlfmvkp skkdypdyyk iilepmdlki iehnirndky ageegmiedm klmfrnarhy
 601  neegsqvynd ahileklkke krkelgplpd dddmaspklk lsrksgispk kskymtpmqg
 661  klnevyeavk nytdkrgrrl saiflrlpsr selpdyylti kkpmdmekir shmmankyqd
 721  idsmvedfvm mfnnactyne pesliykdal vlhkvlletr rdlegdedsh vpnvtlliqe
 781  lihnlfvsvm shqddegrcy sdslaeipav dpnfpnkppl tfdiirknve nnryrrldlf
 841  qehmfevler arrmnrtdse iyedavelqg ffikirdelc kngeillspa lsyttkhlhn
 901  dvekerkekl pkeieedklk reeekreaek sedssgaagl sglhrtysqd csfknsmyhv
 961  gdyvyvepae anlqphivci erlwedsage kwlygcwfyr pnetfhlatr kflekevfks
1021  dyynkvpvsk ilgkcvvmfv keyfklcpen frdedvfvce srysaktksf kkiklwtmpi
1081  ssvrfvprdv plpvvrvasv fanadkgdde kntdnsedsr aednfnleke kedvpvemsn
1141  gepgchyfeq lhyndmwlkv gdcvfikshg lvrprvgrie kvvvrdgaay fygpifihpe
1201  eteheptkmf ykkevflsnl eetcpmtcil gkcavlsfkd flscrpteip endillcesr
1261  ynesdkqmkk fkglkrfsls akvvddeiyy frkpivpqke pspllekkiq lleakfaele
1321  ggdddieemg eedseviepp slpqlqtpla seldlmpytp pgstpksakg sakkegskrk
1381  inmsgyilfs semravikaq hpdysfgels rlvgtewrnl etakkaeyeg vmnqgvapmv
1441  gtpapggspy gqqvgvlgpp gqqapppypg phpagppviq qpttpmfvap ppktgrllhs
1501  eaylkyiegl saesnsiskw dqtlaarrrd vhlskeqesr lpshwlkskg ahttmadalw
1561  rlrdlmlrdt lnirqaynle nv
```

SEQ ID NO: 5 Mouse PBRM1 cDNA Sequence (NM_001081251.1)
```
   1  ggatttacgg cagcactggg aggggtgagg gcggtgaggg cggcgggtgc cggagagacg
  61  gccgcggcca gaggagcgct agcagccgtg gcggccacgg ggcggggctc ggcggtcggg
 121  gaccgcagcc ggggctgcag gcggcggagc ggcgggcttg ccaacacttg gtgtcacatg
 181  tgagcctccc acatgtgtgc actctccatt ccagctctgt gattgaactc tgctcttatt
```

TABLE 1-continued

```
 241  gactaggggg cacttgggca ggcatgcttc attcctggag ttgacagtca tttcataaga
 301  agttggattc catgggttcc aagagaagaa gagccacctc tccttccagc agtgtcagtg
 361  gagactttga tgacgggcac cattctgtgc ctacaccagg cccaagcagg aaaaggagaa
 421  gactgtccaa tcttccaact gtagatccta ttgctgtgtg ccatgaactc tataacacca
 481  tccgagacta taaggatgaa cagggcagac tcctctgtga gctgttcatt agggctccaa
 541  agcggagaaa tcaaccagac tattatgaag tggtttctca gcccattgac ttgatgaaaa
 601  tccaacagaa acttaaaatg aagagtatg atgatgttaa tctactgact gctgacttcc
 661  agctgctttt taacaatgca aaggcctact ataagccaga ttcccctgag tataaagctg
 721  cttgtaaact ctgggatttg taccttcgaa caagaaatga gtttgttcag aaaggagaag
 781  cagacgatga agatgatgac gaagatgggc aagacaatca aggcacactg gctgacggct
 841  cttctccagg ttatctgaag gagatcctgg agcagcttct tgaagccata gttgtagcca
 901  caaatccatc aggacggctc atcagtgaac tttttcagaa actgccttcc aaagtgcaat
 961  atccagacta ttatgcaata attaaggaac ctatagatct caagaccatt gctcagagga
1021  tacagaatgg aagctacaaa agtatacacg caatggccaa agatatagat cttctagcaa
1081  aaaatgccaa acatacaat gagcctgggt ctcaagtatt caaggatgcc aattcgatta
1141  aaaaaatatt ttatatgaaa aaggcagaaa ttgaacatca tgaaatgact aaatcaagtc
1201  ttcgaataag gactgcatca aatttggctg cagccaggct gacaggtcct tcgcacaata
1261  aaagcagcct tggtgaagaa agaaacccca ctagcaagta ttaccgtaat aaaagagcag
1321  tccaagggg tcgcttgtca gcaattacca tggcacttca gtatggatca gagagtgaag
1381  aggacgctgc tttagctgct gcacgctatg aagaagggga atctgaagca gagagcatca
1441  cttccttcat ggacgttccc aaccccttc atcagcttta cgacacagtt aggagctgta
1501  ggaatcacca agggcagctc atagctgaac ctttcttcca tttgccttca aagaaaaat
1561  acccagatta ttatcagcaa attaaaatgc ccatatcact tcaacagatc agaacaaagc
1621  taaagaacca agaatatgaa actttagatc atttggagtg tgatctgaat ttaatgtttg
1681  aaaatgccaa acgttataac gttcccaatt cagccatcta taagcgagtt ctaaaactgc
1741  agcaagtcat gcaggcaaag aagaaggagc ttgcgaggag agatgacatt gaggacggag
1801  acagcatgat ctcctcagcc acttctgaca ctggtagtgc caaaaggaaa aggaatactc
1861  atgacagtga gatgttgggt ctcaggaggc tatccagtaa aaagaacata agaaaacagc
1921  gaatgaaaat tttattcaat gttgttcttg aagctcgaga gccaggttca ggcagaagac
1981  tttgcgatct atttatggtt aagccatcca agaaggacta tcctgattat tataaaatca
2041  tcttagagcc aatggacctg aaaataattg agcataacat ccgaaatgac aaatatgcag
2101  gtgaagaagg aatgatggaa gacatgaaac tcatgttccg caatgccagg cactacaatg
2161  aggagggctc ccaggtatac aatgatgccc atatcctgga gaagttactc aaagataaaa
2221  ggaaagagct gggccctctg cctgatgatg atgacatggc ttctcccaaa cttaaattga
2281  gtaggaagag tggtgtttct cctaagaaat caaagtacat gactccaatg cagcagaaac
2341  tgaatgaagt gtatgaagct gtaagaaact atactgataa gaggggtcgc cgccttagtg
2401  ctatatttct aagactcccc tctagatcag agctgcctga ctactacctg accattaaaa
2461  agcccatgga catggaaaaa attcgaagtc acatgatggc aaacaagtac caagacatag
2521  attctatggt agaggacttt gtcatgatgt ttaataatgc ctgtacctac aatgaaccag
2581  agtctttgat ctacaaagat gcccttgtac tgcataaagt cctccttgag actcggagag
```

TABLE 1-continued

```
2641  acctggaggg agatgaggat tctcatgtcc ctaatgtgac gttgctgatt caagagctca
2701  tccataacct ttttgtgtca gtcatgagtc atcaggatga cgaagggagg tgttacagcg
2761  actccttagc agaaattcct gctgtggatc ccaactctcc caataaacct ccccttacat
2821  ttgacattat caggaaaaat gttgaaagta atcggtatcg gcgacttgat ttatttcagg
2881  agcatatgtt tgaagtattg aacgggcaa gaaggatgaa ccggacagat tccgaaatat
2941  atgaggatgc tgtagaactt cagcagtttt ttattagaat tcgtgatgaa ctctgcaaaa
3001  atggagagat ccttctttct ccagcactca gctataccac aaaacacttg cataacgatg
3061  tggaaaaaga aaaaaggaa aaattgccta agaaataga ggaagataaa ctaaaacgcg
3121  aagaagaaaa aagagaagct gaaaaaagtg aagattcctc aggtactaca ggcctctcag
3181  gcttacatcg tacatacagc caggactgca gctttaagaa cagcatgtat catgtcggag
3241  attatgtcta tgttgaacct gcggaggcca atctacaacc acatatagtg tgtattgaga
3301  gactgtggga ggattcagct ggtgaaaaat ggttgtacgg ctgttggttt tatcggccaa
3361  atgaaacatt ccatttggct acacgaaaat ttctagaaaa agaagttttt aagagtgact
3421  actacaataa agtacctgtt agtaaaattc taggcaaatg tgtagtcatg tttgtcaagg
3481  aatactttaa attatgtcca gaaaactttc gcgatgagga tgttttttgtc tgtgaatcga
3541  ggtattctgc caaaaccaaa tcttttaaga aaattaaact gtggaccatg cccatcagtt
3601  cagttagatt tgtccctcgg gatgtgcctt tgcctgtggt ccgagtggcc tctgtgtttg
3661  caaatgcaga taagggat gatgagaaga atacagacaa ctcagatgac aatagagctg
3721  aagacaattt taacttggaa aaggaaaaag aagatgttcc tgtggagatg tccaatggtg
3781  agccaggttg ccactacttt gagcagcttc ggtacaatga catgtggctg aaggttggtg
3841  attgtgtctt catcaaatcc cacggcttgg tgcgccctcg tgtgggcaga attgagaaag
3901  tatgggtccg agatggagct gcatattttt atggcccat cttcattcat ccagaagaaa
3961  cagaacatga gcccacaaaa atgttctaca aaaagaagt gtttctgagt aatctggaag
4021  agacctgccc tatgagttgt attctgggga aatgtgcagt gctgtcattc aaggacttcc
4081  tctcctgcag gccaactgaa ataccagaaa atgacattct gctttgtgag agccgctata
4141  atgagagtga caagcagatg aagaagttca agggtttgaa gaggttttca ctctctgcta
4201  aagttgtaga tgatgaaatc tactacttca gaaaaccaat cattcctcag aaggaaccct
4261  caccttttgt agaaaagaag atacaattgc tagaagctaa atttgcagag ttagaaggag
4321  gagatgatga tattgaggag atggagaag aggatagtga agtcattgaa gctccatctc
4381  tacctcaact gcagacaccc ctggccaatg agttggacct catgccctat acaccccccac
4441  agtctacccc aaagtctgcc aaaggcagtg caaagaagga aagttctaaa cgaaaaatca
4501  acatgagtgg ctacattttg ttcagcagtg aaatgagagc tgtgattaaa gcccagcacc
4561  cagactactc ttttggggag ctcagcagac tggtgggac agaatggaga aaccttgaaa
4621  cagccaagaa agcagaatat gaagagcggg cagctaaagt tgctgagcag caggagagag
4681  agcgagcagc acagcaacag cagccgagtg cttctccccg agcaggcacc cctgtggggg
4741  ctctcatggg ggtggtgcca ccaccaacac caatgggat gctcaatcag cagttgacac
4801  ctgttgcagg catgatgggt ggctatccgc caggccttcc acctttgcag ggcccagttg
4861  atggccttgt tagcatgggc agcatgcagc cacttcaccc tggggggcct ccacctcacc
4921  atcttccgcc aggtgtgcct ggcctcccag gcatcccacc accgggtgtg atgaatcaag
4981  gagtagcccc catggtaggg actccagcac caggtggaag tccgtatgga caacaggtag
```

TABLE 1-continued

```
5041  gagttttggg acctccaggg cagcaggcac cacctccata tcctggtcct catccagctg
5101  gccccctgt catacagcag ccaacaacgc ccatgtttgt ggctccccca ccaaagaccc
5161  aaaggcttct ccactcagag gcctacctga aatacattga aggactcagt gctgaatcca
5221  acagcattag caagtgggac caaactttgg cagctcgaag acgggatgtc catttgtcca
5281  aagaacagga gagccgccta ccttctcact ggctcaaaag taaaggggca cacaccacca
5341  tggcagatgc cctctggcgc ctacgggatt taatgcttcg agacactctc aacatccgac
5401  aggcatacaa cctagaaaat gtttaatcac atcactgttt cttctgtgga agcaaagagt
5461  tgtggagcgg tagccatttt agttactggg gtgggaggga ggaacaaagg atgataattt
5521  ttattgcatt ttattgtaca tcacacagcc attttttatat aaggacactt taataagct
5581  atttcaaatt tggttttgtt acattaagtt gactatcaaa tacacaaaag atttttttg
5641  catatgtttc ctttgtttaa aaccagtttc ataattggtt atatatagta atagttttat
5701  ctttacttgt taaaggactt aaatcatcaa aggttttggc ttggcttagg gttttcgttt
5761  tcttttttat aaatatatat tatatatata tacacatata aagaaaaaa tgaaaaaaaa
5821  gtttacaaat ttaagttgac aatgaaatgt gaagttggtc ctagtttaca tcttagagga
5881  atgtatatgt atgttttaca tgcctaaata tctgcaggtt ttcttacagg taaagcgaag
5941  tgctttgaaa agtttagatt atacatgtgt gacagatgcg gcatattgc tctattaaca
6001  cagaggctta ctatagaaat ctaaagtcaa tgctgtacat ccatccagtt agtgtaactg
6061  aagggaaatg taactttgtg ctgagttaga catctgtatt gtcagtgatt cttgtagaat
6121  atgtgctcag atctgagtta tatttagttt tggaaggtaa gttgaagagt acttttgatc
6181  agtttatgat tcagtttatg attttagttt ttgccttcat gttatacatt tatgatttga
6241  aactgtacat ctgttacctt gaaaaacatt gaagaaagta ctgaagtgtg catggaggtg
6301  gtttaagcat aatacttaac ccaagaaaga gtgtaagtgg acacaagctg tgcctgcaca
6361  tagctgtgca gggtagactg cctacataca catggccggg attctttatt tccttgttat
6421  caattatagt gctttgtttg tttcagggtt ggaattctca accagaaata atactttcta
6481  aaatatttta aaattcagct tgtgctttgg attatagaag gaaattatac tttaagaaaa
6541  tgttcacaaa aaaaaaaaaa aaaaaggac tattacagat cccaatactt ggatttggtg
6601  accttgtctt tctttctttt cttgagacat ggtcctacta ccaaccctgg ctggactgga
6661  gctcagtgta tagaccaggc tagtctcaaa ctctgcctct tcctcccaag tgctgggatt
6721  aagggcaggt accatagtgc tcagcaacca caaccctgtc tttccaacac ggccctagcg
6781  taagcactga ggcagtgtgc agtgctcagg cagcagcaaa catttcccgg gggtggtttt
6841  gaacctgctt gggtggttgt gtggtgctga cgctgccact gccctgttgt tcattgagaa
6901  tgattgttaa atgacactct tcctttagaa tataacggat cagtactcat gtttaattgc
6961  catgcttaat aaatcatgag aacaaaagag tatagaatgg aaagcattcc ctggtagcta
7021  ctttaaatac aggagccctg taacttaata ccagtagtca accactggat ctcagttttc
7081  atcaagtatt ttaaataaat aatcttaaat tttaaaatac gtactgcaga gtatgccagt
7141  atcttattgt taaaactgaa tcaaataaat cttcgattcc tggttatttg gaccattgac
7201  tcatcatgga ctatataatg taataagatt cttttctctt aaggtatcct tgaattacac
7261  caaagaacca gaaacttaat tttggttaaa ttatttattt atttcatgca ttaattttct
7321  ttttcttttt aaaggtttag atgaggctcc ttagggagtc tctaaaaccg cttcactatc
7381  agcaaccagg agtactagaa gccagagcac tcttcctcct ggctcctccc cagtgctcta
```

TABLE 1-continued

```
7441  gtgctgtagg aaccaagagc cagccccagg ttccccgagg cagtaaaaat ccagcacagg
7501  gggctgtgtc cctaaggcaa gccctgatta cctttaaaaa aaaccaaaaa aacaaacaaa
7561  aaaaaaaaac ctaattaact aaagcattta aggcactatt tattttagaa tcatgctttt
7621  gaagagcatc agtgattact tagggtgtaa tatgtaaaga tcagacatct ccaaaaacag
7681  aaaaagtaca agtaaacaac acactttctc atgactttta agaactgtag taatgtggct
7741  taggaaatat aatggcctaa ttgttttcaa aatgtaagtt cctgtgaaga atttttgttta
7801  tattgggttg gggacctata ggtttaaaat agaatgtcag tcagctgact taaaaaacat
7861  tggttttact aagtctgcct tccccttcta aggaagaact gagtgggtaa gggacaggtg
7921  tgtaaaatct ccaaatggat gttacagctt tcagcttgaa cgtttgtttc cagacctgat
7981  taaaatttgg tttattctaa tttctgtact atatcatctg aggttttaag tggtaactgg
8041  ttctatacca tgtatgtatc atatgtttgt tcatcaaagc ttttttaatcc aaataaaaac
8101  aacagtttgc aaagtga
```

SEQ ID NO: 6 Mouse PBRM1 Amino Acid Sequence (NP_001074720.1)

```
   1  mgskrrrats psssysgdfd dghhsvptpg psrkrrrlsn lptvdpiavc helyntirdy
  61  kdeqgrllce lfirapkrrn qpdyyevvsq pidlmkiqqk lkmeeyddvn lltadfqllf
 121  nnakayykpd speykaackl wdlylrtrne fvqkgeadde dddedgqdnq gtladgsspg
 181  ylkeileqll eaivvatnps grliselfqk lpskvqypdy yaiikepidl ktiagrigng
 241  syksihamak didllaknak tynepgsqvf kdansikkif ymkkaeiehh emtksslrir
 301  tasnlaaarl tgpshnkssl geernptsky yrnkravqgg rlsaitmalq ygseseedaa
 361  laaaryeege seaesitsfm dvsnpfhqly dtvrscrnhq gqliaepffh lpskkkypdy
 421  yggikmpisl gqirtklknq eyetldhlec dlnlmfenak rynvpnsaiy krvlklqqvm
 481  qakkkelarr ddiedgdsmi ssatsdtgsa krkrnthdse mlglrrlssk knirkqrmki
 541  lfnvvleare pgsgrrlcdl fmvkpskkdy pdyykiilep mdlkiiehni rndkyageeg
 601  mmedmklmfr narhyneegs qvyndahile kllkdkrkel gplpddddma spklklsrks
 661  gvspkkskym tpmqqklnev yeavknytdk rgrrlsaifl rlpsrselpd yyltikkpmd
 721  mekirshmma nkyqdidsmv edfvmmfnna ctynepesli ykdalvlhkv lletrrdleg
 781  dedshvpnvt lligelihnl fvsvmshqdd egrcysdsla eipavdpnsp nkppltfdii
 841  rknvesnryr rldlfgehmf evlerarrmn rtdseiyeda velqqffiri rdelckngei
 901  llspalsytt khlhndveke kkeklpkeie edklkreeek reaeksedss gttglsglhr
 961  tysqdcsfkn smyhvgdyvy vepaeanlqp hivcierlwe dsagekwlyg cwfyrpnetf
1021  hlatrkflek evfksdyynk vpvskilgkc vvmfvkeyfk lcpenfrded vfvcesrysa
1081  ktksfkkikl wtmpissvrf vprdvplpvv rvasvfanad kgddekntdn sddnraednf
1141  nlekekedvp vemsngepgc hyfeqlrynd mwlkvgdcvf ikshglvrpr vgriekvwvr
1201  dgaafygpi fihpeetehe ptkmfykkev flsnleetcp mscilgkcav lsfkdflscr
1261  pteipendil lcesrynesd kqmkkfkglk rfslsakvvd deiyyfrkpi ipqkepspll
1321  ekkiqlleak faeleggddd ieemgeedse vieapslpql qtplaneldl mpytppgstp
1381  ksakgsakke sskrkinmsg yilfssemra vikaqhpdys fgelsrlvgt ewrnletakk
1441  aeyeeraakv aeqqerereaa qqqqpsaspr agtpvgalmg vvppptpmgm lnqqltpvag
1501  mmggyppglp plqgpvdglv smgsmqplhp ggppphhlpp gvpglpgipp pgvmnqgvap
1561  mvgtpapggs pygqqvgvlg ppgqqapppy pgphpagppv iqqpttpmfv apppktqrll
```

TABLE 1-continued

```
1621  hseaylkyie glsaesnsis kwdqtlaarr rdvhlskeqe srlpshwlks kgahttmada
1681  lwrlrdlmlr dtlnirqayn lenv
```

SEQ ID NO: 7 Human ARID2 cDNA Sequence Vairant 1 (NM_152641.3, CDS from 129 to 5636)

```
   1  ggcccatgac tgagccccgc cgccgccggc cgaggaatgg gctccgggct ctggtaggaa
  61  gcgctgggag cggggggcgc ttttaaaaca ccgatctggg ttttttaaaa acctcctttg
 121  aaaaaataat ggcaaactcg acggggaagg cgcctccgga cgagcggaga aagggactcg
 181  ctttcctgga cgagctgcgg cagttccacc acagcagagg gtcgccttt aaaaaaatcc
 241  ctgcggtggg tgggaaggag ctggatcttc acggtctcta caccagagtc actactttag
 301  gcggattcgc gaaggtttct gagaagaatc agtggggaga aattgttgaa gagttcaact
 361  ttcccagaag ttgttctaac gctgcctttg ctttaaaaca gtattacttg cgttacctag
 421  aaaagtacga gaaagttcat cattttgggg aggatgatga tgaggtacca ccaggcaatc
 481  caaagccaca gcttcctatt ggtgcaattc catcttccta caattaccag caacacagtg
 541  tgtcggatta tctgcgtcaa agttatgggc tgtccatgga ctttaattcg ccaaatgatt
 601  ataataaatt ggtgcttca ctgttatctg gactcccaaa tgaagtggac tttgctatta
 661  acgtatgcac tctcctatca aatgaaagca agcacgtcat gcaacttgaa aaagatccta
 721  aaatcatcac tttactactt gctaatgccg gggtgtttga cgacacttta ggatcctttt
 781  ccactgtatt tggagaagaa tggaaagaga agactgatag agacttcgtt aagttttgga
 841  aagacatcgt tgatgataat gaagttcgtg acctcatttc tgacagaaac aagtctcatg
 901  aaggtacatc aggagaatgg atttgggagt ctttatttca tccacctcga aagctgggca
 961  ttaacgatat tgaaggacag cgggtacttc agattgcagt gattttgaga aatctttcct
1021  ttgaggaggg caatgttaag ctcttggcag ctaatcgtac ctgtcttcgt ttcctattac
1081  tttctgcaca tagtcatttt atttctttaa ggcaattagg ccttgacaca ttaggaaata
1141  ttgcagctga gcttttactg gaccctgttg atttcaaaac tactcatctg atgtttcata
1201  ctgttacaaa atgtctaatg tcaagggata gattttttaaa gatgagaggc atggaaattt
1261  tgggaaatct ttgcaaagca gaagataatg gtgttttaat ttgtgaatat gtggatcagg
1321  attcctacag agagatcatt tgtcatctca ctttacctga tgtgctgctt gtaatctcaa
1381  cactcgaggt gctatacatg ctcacggaaa tgggagatgt tgcttgcaca aaaattgcaa
1441  aagtagaaaa gagcatagac atgttagtgt gtctggtttc tatggatatt cagatgtttg
1501  gccctgatgc actagctgcg gtaaaactca ttgaacaccc aagttccagt catcaaatgt
1561  tatctgaaat taggccacaa gctatagagc aagtccaaac ccagactcat gtagcatctg
1621  ccccagcttc cagagcagtt gtagcgcagc atgttgctcc acctccagga atagtggaaa
1681  tagatagtga aagtttgct tgtcagtggc taaatgctca ttttgaagta atccagatt
1741  gttctgtttc tcgagcagaa atgtattctg aatacctctc gacttgcagt aaattagctc
1801  gtggtggaat cctaacatca actggatttt ataaatgtct tagaacggtc tttccaaatc
1861  atacagtgaa gagagtggag gattccagta gcaatgggca ggcacatatt catgtggtag
1921  gagtaaaacg gagggctata ccacttccca ttcagatgta ctatcagcag caaccagttt
1981  ctacttctgt tgttcgtgtt gattctgttc ctgatgtatc tcctgctcct tcacctgcag
2041  gaatccctca tggatcacaa accataggaa accattttca gaggactcct gttgccaacc
2101  aatcttcaaa tctgactgca acacaaatgt cttttcctgt acaaggtgtt catactgtgg
2161  cacaaactgt ttcaagaatt ccacaaaatc cttcacctca tacccaccag caacaaaatg
```

TABLE 1-continued

```
2221  ctccagtgac tgtcattcaa agtaaagctc caattccttg tgaagttgtt aaggctacag
2281  ttatccagaa ttccataccc cagacaggag ttcctgttag tattgctgtt ggaggaggac
2341  ctccacagag ttctgttgtt cagaatcata gtacagggcc acaacctgtt acagttgtga
2401  attctcagac attgcttcac catccatctg taattccaca gcagtctcca ttacacacag
2461  tggtaccagg acagatccct tcaggcactc ctgttacagt aattcaacaa gctgtcccac
2521  agagtcatat gtttggcaga gtacagaaca taccagcatg tacttctaca gtttcacagg
2581  gtcaacagtt aatcaccaca tcaccccaac ctgtgcaaac ttcatctcaa cagacatcag
2641  ctggtagcca gtcacaagat actgttatca tagcaccccc acagtatgta acaacttctg
2701  catccaatat tgtctcagca acttcagtac agaattttca ggtagctaca ggacaaatgg
2761  ttactattgc tggtgtccca agtccacaag cctcaagggt agggtttcag aacattgcac
2821  caaaacctct cccttctcag caagtttcat ctacagtggt acagcagcct attcaacaac
2881  cacagcagcc aacccaacaa agcgtagtga ttgtaagcca gccagctcaa caaggtcaaa
2941  cttatgcacc agccattcac caaattgttc ttgctaatcc agcagctctt ccagctggtc
3001  agacagttca gctaactgga caacctaaca taactccatc ttcttcacca tcacctgtcc
3061  cagctactaa taaccaagtc cctactgcca tgtcgtcgtc ctctacccct caatcacagg
3121  gaccacctcc tactgtcagt caaatgttat ctgtgaaaag gcagcaacag cagcaacatt
3181  caccagcacc cccaccacag caggtacaag tacaagttca gcagcccaa caagtacaga
3241  tgcaagttca acctcaacag tcgaatgcag gagttggtca gcctgcctct ggtgagtcga
3301  gtctgattaa acagcttctg cttccgaaac gtggtccttc aacaccaggt ggtaagctta
3361  ttctcccagc tccacagatt cctcccccta ataatgcaag agctcctagc cctcaggtgg
3421  tctatcaggt ggccagtaac caagccgcag gttttggagt gcaggggcaa actccagctc
3481  agcagctatt ggttgggcag caaaatgttc agttggtccc aagtgcaatg ccaccctcag
3541  ggggagtaca aactgtgccc atttcgaact tacaaatatt gccaggtcca ctgatctcaa
3601  atagcccagc aaccattttc caagggactt ctggcaacca ggtaaccata acagttgtgc
3661  caaatacgag ttttgcacct gcaactgtga gtcagggaaa tgcaactcag ctcattgctc
3721  cagcaggaat taccatgagc ggaacgcaga caggagttgg acttccagta caaacgcttc
3781  cagccactca agcatctcct gctggacaat catcatgtac tactgctact ccccccattca
3841  aaggtgataa aataatttgc caaaaggagg aggaagcaaa ggaagcaaca ggtttacatg
3901  ttcatgaacg taaaattgaa gtcatggaga acccgtcctg ccgacgagga gccacaaaca
3961  ccagcaatgg ggatacaaag gaaaatgaaa tgcatgtggg aagtctttta aatgggagaa
4021  agtacagtga ctcaagtcta cctccttcaa actcagggaa aattcaaagt gagactaatc
4081  agtgctcact aatcagtaat gggccatcat tggaattagg tgagaatgga gcatctggga
4141  aacagaactc agaacaaata gacatgcaag atatcaaaag tgatttgaga aaaccgctag
4201  ttaatggaat ctgtgatttt gataaaggag atggttctca tttaagcaaa aacattccaa
4261  atcataaaac ttccaatcat gtaggaaatg gtgagatatc tccaatggaa ccacaaggga
4321  ctttagatat cactcagcaa gatactgcca aaggtgatca actagaaaga atttctaatg
4381  gacctgtatt aactttgggt ggttcatctg tgagcagtat acaggaggct tcaaatgcgg
4441  caacacagca atttagtggt actgatttgc ttaatggacc tctagcttca agtttgaatt
4501  cagatgtgcc tcagcaacgc ccaagtgtag ttgtctcacc acattctaca acctctgtta
4561  tacagggaca tcaaatcata gcagttcccg actcaggatc aaaagtatcc cattctcctg
```

TABLE 1-continued

```
4621  ccctatcatc tgacgttcgg tctacaaatg gcacagcaga atgcaaaact gtaaagaggc 4681  cagcagagga tactgatagg gaaacagtcg caggaattcc aaataaagta ggagttagaa 4741  ttgttacaat cagtgacccc aacaatgctg gctgcagcgc aacaatggtt gctgtgccag 4801  caggagcaga tccaagcact gtagctaaag tagcaataga aagtgctgtt cagcaaaagc 4861  aacagcatcc accaacatat gtacagaatg tggtcccgca gaacactcct atgccacctt 4921  caccagctgt acaagtgcag ggccagccta acagttctca gccttctcca ttcagtggat 4981  ccagtcagcc tggagatcca atgagaaaac ctggacagaa cttcatgtgt ctgtggcagt 5041  cttgtaaaaa gtggtttcag acaccctcac aggttttcta ccatgcagca actgaacatg 5101  gaggaaaaga tgtatatcca gggcagtgtc tttgggaagg ttgtgagcct tttcagcgac 5161  agcggttttc ttttattacc cacttgcagg ataagcactg ttcaaaggat gccctacttg 5221  caggattaaa acaagatgaa ccaggacaag caggaagtca gaagtcttct accaagcagc 5281  caactgtagg gggcacaagc tcaactccta gagcacaaaa ggccattgtg aatcatccca 5341  gtgctgcact tatggctctg aggagaggat caagaaacct tgtctttcga gattttacag 5401  atgaaaaaga gggaccaata actaaacaca tccgactaac agctgcctta atattaaaaa 5461  atattggtaa atattcagaa tgtggtcgca gattgttaaa gagacatgaa ataacttat 5521  cagtgctagc cattagtaac atggaagctt cctccaccct tgccaaatgc ctttatgaac 5581  ttaattttac agttcagagt aaggaacaag aaaaagactc agaaatgctg cagtgaaaaa 5641  taattccact tacacagtgg gggactcaaa gtcagccaca tttcacatac tgttactgaa 5701  gaaagcacca agtcttaatg gaacaaagac catagaatga attatttat ctcctcccat 5761  gatgctgaga ggaagcttcg tattctgatc tctgagtgaa tcccttgtt ctctgtttaa 5821  aaaaatctaa aagaaaaag gaaaaaaaaa aaagaactgc tgtgggattg tcaaccagct 5881  tatctgcagg atgtttcaga tctgataaat cctgatggaa actggtatga tcagaattca 5941  gtaccatcca cattggaata tacatggaat attgtaaaac ctacatgagc agatgaaata 6001  gaagcattaa atattttat ctatatccaa aaaggagcac atttttatat ttacaaaacc 6061  gtttaagctg gtttgaataa tttaaaaaag tttcagcaca cctataccc cgatctcaga 6121  gggggccacc aatatctagc tatggatcgt gtgttttgtt tagaaatcag tagcttggtt 6181  ttcttacttg agccaatata ttttcactta tttattatca taaaaattta ccagtctgaa 6241  tagatcttgt aaatatttgt gaatagaatg aatacctttc atgccactgc agccactgga 6301  aatacattct gtggtgtcct agaagcatta ttggtaggtt ctaaagtttt ctagactttc 6361  ctgtcaattg taagtaattg tgatatattc tatgcagtgg atgaatgttc tttaaatttg 6421  tgtaaatact tctgcaaagg tactgatgct gtaaagtcaa aacagttttg tggaactgtg 6481  attttttttt ctttttttctt ttttttttc tttttttttt tgtattatac accttgtaga 6541  actcatttg ctggctgaaa gagtatggaa taatatatct catgtcattt tttagaagaa 6601  aaactatttg aaggtatttt ttggttttcc ttaacatgta tccactgtaa acgtttgtcg 6661  tgtacaagct cagagcttgg acagaatttt ttgtatttgt aaattggttt aaatacatgg 6721  aattttatac aggttttctc ctgtgttata tatgcattat gtgcaggtat gatattttct 6781  tcactacttt ttctatctta atatagtgtg gaatttatt gtattattct tccattctta 6841  atactgtacc acattcctgc tcagaaactg ctcacttcct taaattgtct ttttcccc 6901  agcgtgaaat gtatccatt ataactgcct attgcctgtt ctattagcat ccaaaaatgt 6961  ggaaggcctc ccaaccacca tttctgctgt gtccttagga tgtgcagtaa aaatataga
```

TABLE 1-continued

```
7021  cctaacagtt tatgttatag aatggcttta tttactttgg tgactgttta tagtttttaa
7081  ataaaagact gaacattttc ttgagtcctt catttctgag tatgcttaag acatcttaaa
7141  aatatagaga gaattctaaa ttcagctgaa ggcaaggtat aacggtcacc tacctatttg
7201  attatatgtt gattgataac atattaaata gagaacaaat aagagaggtc ctttacatga
7261  caaatttgca tgaaataagc agattaacca agtatttatt tttcatcttg ttataatgca
7321  gagcaaatgt agagaacagc aaatgattga tgcagttaaa gctcaatatg cctttttta
7381  ctggatactg tacatttggc taaaagcttt tattgtttga tgttgtgttt cttgactgtt
7441  tattcagaat cacagtgtat ccaaatcttc agcttgaatt tggaggcaga ttcttagagt
7501  gaaaaagcct cagtttccat attaaaaatg ttttaaatat tttgattgaa ttagtaccaa
7561  tgtaaaatct agtttcttcc tgaaggagga tccctggcgc tgtcctgcca tgtctcaaag
7621  gaatgtttga gaaacttcat ctaatattag ttataaggtt gtggaattta tgcttggccc
7681  accttccaag actggcactg cccaacagac accgctgaaa tcatgtgggt atccctagga
7741  tggccttcag agccctcaaa cttacaagca cctggtagtt gacatcatat ggggaatttt
7801  ctattcaccg tacttatcca aaaatctctt ttaaaaagta aatttgtgca acaacgttta
7861  tttgaaagat aatgtcttct caaaatcaga aactgcagtg gtaattaaat taatagaaaa
7921  gagaacaaac tgcaggttta gaaaaatggt tttcatattc accattcttc cacctcattg
7981  aattgcatgc tgtagttcta gcttttctgc tataatatgt aaatatgact gtagcctttt
8041  aagcttcagt ctcagcagag aatttcctaa atgcgtttga cctaatgaaa ctgatcatgg
8101  cttcccactt aggtttttct tcttatagct ttatagaact atataataat atggacttgc
8161  tgtgtaatgg aattaaagtg cttttgcaca ataagttctg caaaaccctc tcattcatga
8221  aaaggtgctc cttgctagac agaaacttgc tgatttacag tattgttatt tttgtctaaa
8281  gttctgtaaa tacatgcttt aatgttatct ttgagaaatc tatgtaaata atatagtcta
8341  caacatagag actgtataat tctgtgttat atatgtgcct agtgctctgt tggcactcaa
8401  taaattttaa gtaacaaaat tgataatcat atagcgaagg catatttttc ttccaagctc
8461  aagtcaggat tgtgactata tattaatgag actcagtaat ccaacccaca cctgagaact
8521  cgtctcatta ctttatagtc atgtcatgta tgttttttta accatgaaat gacaataaaa
8581  tgatttttaa aatgagaaaa aaaaaaaaaa aaaaaaaa
```

SEQ ID NO: 8 Human ARID2 Amino Acid Sequence Isoform A (NP_689854.2)
```
  1  manstgkapp derrkglafl delrqfhhsr gspfkkipav ggkeldlhgl ytrvttlggf
 61  akvseknqwg eiveefnfpr scsnaafalk qyylryleky ekvhhfgedd devppgnpkp
121  qlpigaipss ynyqqhsysd ylrqsyglsm dfnspndynk lvlsllsglp nevdfainvc
181  tllsneskhv mqlekdpkii tlllanagvf ddtlgsfstv fgeewkektd rdfvkfwkdi
241  vddnevrdli sdrnkshegt sgewiweslf hpprklgind ieggrvlgia vilrnlsfee
301  gnvkllaanr tclrflllsa hshfislrql gldtlgniaa ellldpvdfk tthlmfhtvt
361  kclmsrdrfl kmrgmeilgn lckaedngvl iceyvdqdsy reiichltlp dvllvistle
421  vlymltemgd vactkiakve ksidmlvclv smdiqmfgpd alaavklieh pssshqmlse
481  irpgaieqvg tqthvasapa sravvaqhva pppgiveids ekfacqwlna hfevnpdcsv
541  sraemyseyl stcsklargg iltstgfykc lrtvfpnhtv krvedsssng qahihvvgvk
601  rraiplpiqm yyqqpvsts vvrvdsvpdv spapspagip hgsgtignhf grtpvangss
661  nitatqmsfp vqgvhtvaqt vsripqnpsp hthqqqnapv tvigskapip cevvkatviq
721  nsipqtgvpv siavgggppq ssvvqnhstg pqpvtvvnsq tllhhpsvip qqsplhtvvp
```

TABLE 1-continued

```
 781  gqipsgtpvt viqqavpqsh mfgrvqnipa ctstvsqgqq littspqpvg tssqqtsags
 841  qsqdtviiap pqyvttsasn ivsatsvgnf qvatgqmvti agvpspqasr vgfqniapkp
 901  lpsqqvsstv vqqpiqqpqq ptqqsvvivs qpaqqgqtya paihqivlan paalpagqtv
 961  qltgqpnitp ssspspvpat nnqvptamss sstpqsqgpp ptvsqmlsvk rqqqqqhspa
1021  pppqqvqvqv qqpqqvqmqv qpqqsnagvg qpasgessli kglllpkrgp stpggklilp
1081  apqipppnna rapspqvvyq vasnqaagfg vqgqtpaqql lvgqqnvqlv psamppsggv
1141  qtvpisnlqi lpgplisnsp atifqgtsgn qvtitvvpnt sfapatvsqg natqliapag
1201  itmsgtqtgv glpvqtlpat gaspaggssc ttatppfkgd kiicqkeeea keatglhvhe
1261  rkievmenps crrgatntsn gdtkenemhv gsllngrkys dsslppsnsg kigsetnqcs
1321  lisngpslel gengasgkqn seqidmqdik sdlrkplvng icdfdkgdgs hlskipnhk
1381  tsnhvgngei spmepqgtld itqqdtakgd qlerisngpv ltlggssyss igeasnaatq
1441  qfsgtdllng plasslnsdv pqqrpsvvvs phsttsviqg hqiiavpdsg skvshspals
1501  sdvrstngta ecktvkrpae dtdretvagi pnkvgvrivt isdpnnagcs atmvavpaga
1561  dpstvakvai esavqqkqqh pptyvqnvvp qntpmppspa vqvqgqpnss qpspfsgssq
1621  pgdpmrkpgq nfmclwqsck kwfqtpsqvf yhaatehggk dvypgqclwe gcepfgrqrf
1681  sfithlqdkh cskdallagl kgdepggags qksstkqptv ggtsstpraq kaivnhpsaa
1741  lmalrrgsrn lvfrdftdek egpitkhirl taalilknig kysecgrrll krhennlsvl
1801  aisnmeasst lakclyelnf tvgskegekd semlq
```

SEQ ID NO: 9 Human ARID2 cDNA Sequence Vairant 2 (NM_001347839.1, CDS: from 129 to 5495)

```
   1  ggcccatgac tgagccccgc cgccgccggc cgaggaatgg gctccgggct ctggtaggaa
  61  gcgctgggag cgggggggcgc ttttaaaaca ccgatctggg tttttttaaaa acctcctttg
 121  aaaaaataat ggcaaactcg acggggaagg cgcctccgga cgagcggaga aagggactcg
 181  ctttcctgga cgagctgcgg cagttccacc acagcagagg gtcgcctttt aaaaaaatcc
 241  ctgcggtggg tgggaaggag ctggatcttc acggtctcta caccagagtc actactttag
 301  gcggattcgc gaaggtttct gagaagaatc agtggggaga aattgttgaa gagttcaact
 361  ttcccagaag ttgttctaac gctgcctttg ctttaaaaca gtattacttg cgttacctag
 421  aaaagtacga gaaagttcat cattttgggg aggatgatga tgaggtacca ccaggcaatc
 481  caaagccaca gcttcctatt ggtgcaattc catcttccta caattaccag caacacagtg
 541  tgtcggatta tctgcgtcaa agttatgggc tgtccatgga ctttaattcg ccaaatgatt
 601  ataataaatt ggtgctttca ctgttatctg gactcccaaa tgaagtggac tttgctatta
 661  acgtatgcac tctcctatca aatgaaagca agcacgtcat gcaacttgaa aaagatccta
 721  aaatcatcac tttactactt gctaatgccg gggtgtttga cgacacttta ggatccttt
 781  ccactgtatt tggagaagaa tggaaagaga agactgatag agacttcgtt aagttttgga
 841  aagacatcgt tgatgataat gaagttcgtg acctcatttc tgacagaaac aagtctcatg
 901  aaggtacatc aggagaatgg atttgggagt ctttatttca tccacctcga aagctgggca
 961  ttaacgatat tgaaggacag cgggtacttc agattgcagt gattttgaga atctttcct
1021  ttgaggaggg caatgttaag ctcttggcag ctaatcgtac ctgtcttcgt ttcctattac
1081  tttctgcaca tagtcatttt atttctttaa ggcaattagg ccttgacaca ttaggaaata
1141  ttgcagctga gcttttactg gaccctgttg atttcaaaac tactcatctg atgtttcata
1201  ctgttacaaa atgtctaatg tcaagggata gatttttaaa gatgagaggc atggaaattt
```

TABLE 1-continued

```
1261  tgggaaatct ttgcaaagca gaagataatg gtgttttaat ttgtgaatat gtggatcagg
1321  attcctacag agagatcatt tgtcatctca ctttacctga tgtgctgctt gtaatctcaa
1381  cactcgaggt gctatacatg ctcacggaaa tgggagatgt tgcttgcaca aaaattgcaa
1441  aagtagaaaa gagcatagac atgttagtgt gtctggtttc tatggatatt cagatgtttg
1501  gccctgatgc actagctgcg gtaaaactca ttgaacaccc aagttccagt catcaaatgt
1561  tatctgaaat taggccacaa gctatagagc aagtccaaac ccagactcat gtagcatctg
1621  ccccagcttc cagagcagtt gtagcgcagc atgttgctcc acctccagga atagtggaaa
1681  tagatagtga aagtttgct tgtcagtggc taaatgctca ttttgaagta aatccagatt
1741  gttctgtttc tcgagcagaa atgtattctg aatacctctc gacttgcagt aaattagctc
1801  gtggtggaat cctaacatca actggatttt ataaatgtct tagaacggtc tttccaaatc
1861  atacagtgaa gagagtggag gattccagta gcaatgggca ggcacatatt catgtggtag
1921  gagtaaaacg gagggctata ccacttccca ttcagatgta ctatcagcag caaccagttt
1981  ctacttctgt tgttcgtgtt gattctgttc ctgatgtatc tcctgctcct tcacctgcag
2041  gaatccctca tggatcacaa accataggaa accattttca gaggactcct gttgccaacc
2101  aatcttcaaa tctgactgca acacaaatgt ctttttcctgt acaaggtgtt catactgtgg
2161  cacaaactgt ttcaagaatt ccacaaaatc cttcacctca tacccaccag caacaaaatg
2221  ctccagtgac tgtcattcaa agtaaagctc caattccttg tgaagttgtt aaggctacag
2281  ttatccagaa ttccataccc cagacaggag ttcctgttag tattgctgtt ggaggaggac
2341  ctccacagag ttctgttgtt cagaatcata gtacagggcc acaacctgtt acagttgtga
2401  attctcagac attgcttcac catccatctg taattccaca gcagtctcca ttacacacag
2461  tggtaccagg acagatccct tcaggcactc ctgttacagt aattcaacaa gctgtcccac
2521  agagtcatat gtttggcaga gtacagaaca taccagcatg tacttctaca gtttcacagg
2581  gtcaacagtt aatcaccaca tcaccccaac ctgtgcaaac ttcatctcaa cagacatcag
2641  ctggtagcca gtcacaagat actgttatca tagcaccccc acagtatgta acaacttctg
2701  catccaatat tgtctcagca acttcagtac agaattttca ggtagctaca ggacaaatgg
2761  ttactattgc tggtgtccca agtccacaag cctcaagggt agggtttcag aacattgcac
2821  caaaacctct cccttctcag caagtttcat ctacagtggt acagcagcct attcaacaac
2881  cacagcagcc aacccaacaa agcgtagtga ttgtaagcca gccagctcaa caaggtcaaa
2941  cttatgcacc agccattcac caaattgttc ttgctaatcc agcagctctt ccagctggtc
3001  agacagttca gctaactgga caacctaaca taactccatc ttcttcacca tcacctgtcc
3061  cagctactaa taaccaagtc cctactgcca tgtcgtcgtc ctctaccccct caatcacagg
3121  gaccacctcc tactgtcagt caaatgttat ctgtgaaaag gcagcaacag cagcaacatt
3181  caccagcacc cccaccacag caggtacaag tacaagttca gcagcccaa caagtacaga
3241  tgcaagttca acctcaacag tcgaatgcag gagttggtca gcctgcctct ggtgagtcga
3301  gtctgattaa acagcttctg cttccgaaac gtggtccttc aacaccaggt ggtaagctta
3361  ttctcccagc tccacagatt cctcccccta ataatgcaag agctcctagc cctcaggtgg
3421  tctatcaggt ggccagtaac caagccgcag gttttggagt gcaggggcaa actccagctc
3481  agcagctatt ggttgggcag caaaatgttc agttggtccc aagtgcaatg ccaccctcag
3541  ggggagtaca aactgtgccc atttcgaact tacaaatatt gccaggtcca ctgatctcaa
3601  atagcccagc aaccatttttc caagggactt ctggcaacca ggtaaccata acagttgtgc
```

TABLE 1-continued

```
3661  caaatacgag ttttgcacct gcaactgtga gtcagggaaa tgcaactcag ctcattgctc
3721  cagcaggaat taccatgagc ggaacgcaga caggagttgg acttccagta caaacgcttc
3781  cagccactca agcatctcct gctggacaat catcatgtac tactgctact ccccccattca
3841  aaggtgataa aataatttgc caaaaggagg aggaagcaaa ggaagcaaca ggtttacatg
3901  ttcatgaacg taaaattgaa gtcatggaga acccgtcctg ccgacgagga gccacaaaca
3961  ccagcaatgg ggatacaaag gaaaatgaaa tgcatgtggg aagtctttta aatgggagaa
4021  agtacagtga ctcaagtcta cctccttcaa actcagggaa aattcaaagt gagactaatc
4081  agtgctcact aatcagtaat gggccatcat tggaattagg tgagaatgga gcatctggga
4141  aacagaactc agaacaaata gacatgcaag atatcaaaag tgatttgaga aaaccgctag
4201  ttaatggaat ctgtgatttt gataaaggag atggttctca tttaagcaaa aacattccaa
4261  atcataaaac ttccaatcat gtaggaaatg gtgagatatc tccaatggaa ccacaaggga
4321  ctttagatat cactcagcaa gatactgcca aaggtgatca actagaaaga atttctaatg
4381  gacctgtatt aactttgggt ggttcatctg tgagcagtat acaggaggct tcaaatgcgg
4441  caacacagca atttagtggt actgatttgc ttaatggacc tctagcttca agtttgaatt
4501  cagatgtgcc tcagcaacgc ccaagtgtag ttgtctcacc acattctaca acctctgtta
4561  tacagggaca tcaaatcata gcagttcccg actcaggatc aaaagtatcc cattctcctg
4621  ccctatcatc tgacgttcgg tctacaaatg gcacagcaga atgcaaaact gtaaagaggc
4681  cagcagagga tactgatagg gaaacagtcg caggaattcc aaataaagta ggagttagaa
4741  ttgttacaat cagtgacccc aacaatgctg gctgcagcgc aacaatggtt gctgtgccag
4801  caggagcaga tccaagcact gtagctaaag tagcaataga aagtgctgtt cagcaaaagc
4861  aacagcatcc accaacatat gtacagaatg tggtcccgca gaacactcct atgccaccct
4921  caccagctgt acaagtgcag ggccagccta acagttctca gccttctcca ttcagtggat
4981  ccagtcagcc tggagatcca atgagaaaac ctggacagaa cttcatgtgt ctgtggcagt
5041  cttgtaaaaa gtggtttcag acaccctcac aggtttttcta ccatgcagca actgaacatg
5101  gaggaaaaga tgtatatcca gggcagtgtc tttgggaagg ttgtgagcct ttcagcgac
5161  agcggttttc ttttattacc cacttgcagg ataagcactg ttcaaaggat gccctacttg
5221  caggattaaa acaagatgaa ccaggacaag caggaagtca gaagtcttct accaagcagc
5281  caactgtagg gggcacaagc tcaactccta gagcacaaaa ggccattgtg aatcatccca
5341  gtgctgcact tatggctctg aggagaggat caagaaacct tgtctttcga gattttacag
5401  atgaaaaaga gggaccaata actaaacaca tccgactaac agctgcctta atattaaaaa
5461  atattggtaa atattcagaa tgtggtcgca ggtgagtaat atgttttctg tagccaaagt
5521  gaatttagtt tatttttattt ttacatataa gttaataaaa ttagataact gtatttttctt
5581  cattgttttt ctcatcaatt ttgcaaatac atccaaaagt ttatgcctag gtcaggccat
5641  gatgagctct taaaagtcaa aaataaatag aagttaaaac aaccaaaaaa aaaaaaaaaa
5701  aaa
```

SEQ ID NO: 10 Human ARID2 Amino Acid Sequence Isoform B (NP_001334768.1)
```
  1  manstgkapp derrkglafl delrqfhhsr gspfkkipav ggkeldlhgl ytrvttlggf
 61  akvseknqwg eiveefnfpr scsnaafalk qyylryleky ekvhhfgedd devppgnpkp
121  qlpigaipss ynyqqhsysd ylrqsyglsm dfnspndynk lvlsllsglp nevdfainvc
181  tllsneskhv mqlekdpkii tlllanagvf ddtlgsfstv fgeewkektd rdfvkfwkdi
241  vddnevrdli sdrnkshegt sgewiweslf hpprklgind ieggrvlgia vilrnlsfee
```

TABLE 1-continued

```
 301  gnvkllaanr  tclrflllsa  hshfislrql  gldtlgniaa  ellldpvdfk  tthlmfhtvt
 361  kclmsrdrfl  kmrgmeilgn  lckaedngvl  iceyvdqdsy  reiichltlp  dvllvistle
 421  vlymltemgd  vactkiakve  ksidmlvclv  smdiqmfgpd  alaavklieh  pssshqmlse
 481  irpgaieqvg  tqthvasapa  sravvaqhva  pppgiveids  ekfacqwlna  hfevnpdcsv
 541  sraemyseyl  stcsklargg  iltstgfykc  lrtvfpnhtv  krvedsssng  qahihvvgvk
 601  rraiplpiqm  yyqqqpvsts  vvrvdsvpdv  spapspagip  hgsgtignhf  grtpvangss
 661  nitatqmsfp  vqgvhtvaqt  vsripqnpsp  hthqqqnapv  tvigskapip  cevvkatviq
 721  nsipqtgvpv  siavgggppq  ssvvqnhstg  pqpvtvvnsq  tllhhpsvip  qqsplhtvvp
 781  gqipsgtpvt  viqqavpqsh  mfgrvqnipa  ctstvsqgqq  littspqpvg  tssqqtsags
 841  qsqdtviiap  pqyvttsasn  ivsatsvgnf  qvatgqmvti  agvpspqasr  vgfqniapkp
 901  lpsqqvsstv  vqqpiqqpqq  ptqqsvvivs  qpaqqgqtya  paihqivlan  paalpagqtv
 961  qltgqpnitp  ssspspvpat  nnqvptamss  sstpqsqgpp  ptvsqmlsvk  rqqqqhspa
1021  pppqqvqvqv  qqpqqvqmqv  qpqqsnagvg  qpasgessli  kglllpkrgp  stpggklilp
1081  apqippppnna  rapspqvvyq  vasnqaagfg  vqgqtpaqql  lvgqqnvqlv  psamppsggv
1141  qtvpisnlqi  lpgplisnsp  atifqgtsgn  qvtitvvpnt  sfapatvsqg  natqliapag
1201  itmsgtqtgv  glpvqtlpat  gaspaggssc  ttatppfkgd  kiicqkeeea  keatglhvhe
1261  rkievmenps  crrgatntsn  gdtkenemhv  gsllngrkys  dsslppsnsg  kigsetnqcs
1321  lisngpslel  gengasgkqn  seqidmgdik  sdlrkplvng  icdfdkgdgs  hlskninphk
1381  tsnhvgngei  spmepqgtld  itqqdtakgd  qlerisngpv  ltlggssyss  igeasnaatq
1441  qfsgtdllng  plasslnsdv  pqqrpsvvvs  phsttsviqg  hqiiavpdsg  skvshspals
1501  sdvrstngta  ecktvkrpae  dtdretvagi  pnkvgvrivt  isdpnnagcs  atmvavpaga
1561  dpstvakvai  esavqqkqqh  pptyvqnvvp  qntpmppspa  vqvqgqpnss  qpspfsgssq
1621  pgdpmrkpgq  nfmclwqsck  kwfqtpsqvf  yhaatehggk  dvypgqclwe  gcepfgrqrf
1681  sfithlqdkh  cskdallagl  kgdepggags  qksstkqptv  ggtsstpraq  kaivnhpsaa
1741  lmalrrgsrn  lvfrdftdek  egpitkhirl  taalilknig  kysecgrr
```

SEQ ID NO: 11 Mouse ARID2 cDNA Sequence (NM_175251.4, CDS: from 129 to 5495)

```
   1  gcgccgccgc  cgccgccgcc  gccgccgccg  ccgccgccac  cgccggccca  tgactgagcc
  61  ccgccaccgc  cggccgagga  atgggctccg  gcgctggta  gggagcgcgg  ggagcggggg
 121  ccgcgtttga  accgcgatct  gggttttttc  gggagacctc  ctttggcaaa  ataatggcaa
 181  actcgacggg  gaaggcgcct  ccggacgagc  ggaggaaggg  actggctttc  ctggacgagc
 241  tgcggcagtt  ccaccacagc  agagggtcgc  cgtttaagaa  gatccctgcg  gtgggtggga
 301  aggagctgga  tcttcacggg  ctctacacca  gagtcactac  tttaggcgga  ttcgcgaagg
 361  tttctgagaa  gaatcagtgg  ggagaaattg  ttgaagagtt  caactttccc  agaagttgtt
 421  ccaacgctgc  ctttgctttta  aaacagtatt  acttgcgtta  tctagaaaag  tacgagaaag
 481  ttcatcattt  tggggaagat  gatgatgagg  taccaccagg  caatccaaag  ccacagcttc
 541  ctattggtgc  aatcccatct  tcctacaatt  accagcaaca  cagcgtgtca  gattatctac
 601  gtcaaagtta  tgggttatct  atggatttta  attcgccaaa  tgattataat  aaactggtgc
 661  tttcactgtt  atctggactc  ccaaatgaag  tggacttcgc  tattaatgtg  tgcactctcc
 721  tatcaaatga  aagcaagcac  gtcatgcagc  ttgagaagga  tcccaaaatc  atcactttac
 781  tgctcgctaa  tgcgggggtg  ttcgatgaca  ctttaggatc  attctcttct  gtctttggag
```

TABLE 1-continued

```
 841   aagagtggcg agagaagact gatagagact ttgttaagtt ttggaaagac attgttgatg
 901   acaatgaagt gcgagatctc atttctgaca gaaacaaggc tcatgaagat acaccaggag
 961   aatggatttg ggaatcttta tttcatccac ctcgaaagct gggcattaat gacatcgaag
1021   gccagcgggt tctgcagatc gcagtgatct tgcggaacct ctcctttgag gagagcaatg
1081   ttaagctctt ggcagctaat cgcacctgtc tgcgtttcct gttgctctct gcacacagtc
1141   attttatttc attaaggcag ctaggcctgg acaccttagg gaatatcgca gctgagcttt
1201   tactggaccc tgtggatttc agaaccactc atctgatgtt tcacactgtt acaaaatgcc
1261   tgatgtcaag ggataggttt ttaaagatga ggggcatgga aattttggga aatctctgca
1321   aagcagagga taacggtgtt ttgatttgtg aatatgtgga tcaagattcc tatagagaga
1381   taatttgtca cctcactctg cccgatgtgc tgctggtgac ctcaaccctg gaggtgctgt
1441   acatgctcac tgaaatgggg gacgtggcct gcacaaagat cgcgaaagtg gagaagagca
1501   tagacgtgct ggtgtgtctg gtctctatgg acgctcagat gtttggacct gacgcacttg
1561   ctgccgtgaa gctcattgag catccgagct ccagtcacca agtgttatca gagattaggc
1621   cgcaagccat agagcaggtc caaacccaga cccacatagc ctccggtcca gcttccagag
1681   cagttgtagc acagcatgct gccccccctc caggaatcgt ggaaatagac agtgagaagt
1741   tcgcttgtca gtggctaaat gctcattttg aagtaaatcc agactgttcc gtctctcggg
1801   cagaaatgta ttcagagtac ctctcaactt gcagtaaatt agctcgcggt ggcatcctca
1861   catcaactgg gttttataag tgtcttagaa cagttttttcc aaatcataca gtgaagaggg
1921   tagaagattc cactagcagt gggcaggcgc atatccatgt cataggagtg aagcggcggg
1981   ctctcccgct ccccatccag atgtactatc agcagcagcc aatttccact cctgttgtcc
2041   gtgttgatgc tgttgctgat ctatctccaa ctccttcacc tgcaggaatc cctcatggac
2101   cacaggctgc agggaatcat tttcagagga ctcctgtcac caatcaatct tcaaatttga
2161   ctgcaacaca aatgtctttt ccggtacaag gcattcatac tgtggcacag actgtttcca
2221   gaattccacc aaatccttca gttcataccc accagcaaca aaattctcca gtaactgtca
2281   ttcagaataa agctccaatt ccttgtgaag tcgttaaggc aacagtaatc cagaactctg
2341   tgccccagac ggcagttcct gtgagtatct ctgttggagg agcacctgca cagaattctg
2401   tgggtcagaa ccatagtgca gggccacagc ctgttacagt tgtaaattct cagacattac
2461   ttcaccatcc ttctgtgatg ccacagccat ctccactaca cacagtggtg cccggacagg
2521   tcccttcagg cactcctgtc acagtaatcc agcagactgt accgcagagt cgtatgtttg
2581   gacgagtaca gagcatacca gcgtgtacat ctaccgtctc acagggtcag cagttaatca
2641   ccacatcacc acagcctatg cacacttcat ctcaacagac agcagctggt agccagccac
2701   aagacactgt tatcatagca cccccacagt acgtaacaac ttctgcatcc aatatcgtct
2761   cagcgacttc agtacagaat ttccaggtag ctacaggaca ggtggttacc atagctggtg
2821   tcccgagccc acagccctcc agggtaggat tccagaacat tgcgcccaag ccacttcctt
2881   ctcagcaagt ttcaccatca gtggtccagc agcctattca acaaccacag cagcctgctc
2941   agcagagtgt agtgattgtg agccagccag cacagcaagg ccaggcgtac gcaccagcca
3001   ttcaccagat cgttctcgct aacccggcag ctctccctgc cggtcagacg gttcagctaa
3061   ctggacaacc aaacataact ccatcgtcat caccatcacc tgtcccgcct actaataacc
3121   aagtccctac tgccatgtca tcttcttcca cccttcagtc acagggaccc cctcctactg
3181   tcagtcagat gctctctgtg aagaggcagc agcagcagca gcactcacca gcagcgccag
```

TABLE 1-continued

```
3241 cacagcaggt ccaggtccag gttcagcagc cgcagcaggt ccaggtgcaa gttcagccgc
3301 agcaaccgag tgctggggtc ggtcagcctg ctcccaacga gtctagtctc atcaagcagc
3361 tgctgctgcc aaagcggggc ccttcaaccc caggggggcaa gcttatcctc ccagcccctc
3421 agattcctcc ccctaacaat gcaagagctc ctagccctca ggtggtctat caggtggcca
3481 ataaccaagc agctggtttt ggagtgcagg ggcaaactcc ggctcagcag ctattggttg
3541 ggcagcaaaa tgttcagttg gtccaaagtg caatgccacc cgcaggggga gtgcaaaccg
3601 tgcccatttc gaacttacaa atattgccgg gtccgctgat ctcaaacagc ccagcaacca
3661 ttttccaagg gacttctggc aaccaggtaa ctataacagt gtgccaaat accagttttg
3721 caactgcgac tgtgagtcag ggaaacgctg ctcagctcat tgcgccagcc ggtcttagca
3781 tgagcggagc gcaggcaagc gctggacttc aggtgcagac gcttccagcc ggacaatcag
3841 cgtgtaccac tgctcccctc ccgttcaaag gcgacaagat catttgccaa aaggaggagg
3901 aggcaaagga agcaacaggt ctacatgttc atgaacggaa gattgaggtc atggagaatc
3961 cttcctgtcg gcgaggaacc acaaacacca gcaacgggga tacaagtgag agtgaactcc
4021 aggtgggaag tcttttaaat gggagaaagt atagtgactc aagtctacct ccttcaaact
4081 cagggaaact tcagagtgag acgagccagt gctcactaat cagcaatggg ccatcgttgg
4141 aactaggtga gaatggagcg cctggaaaac agaactcaga accagtagac atgcaggatg
4201 tcaaaggtga tctgaaaaaa gccctcgtca atggaatctg tgatttgat aaaggagatg
4261 gttctcattt aagcaaaaac attccaaatc acaaaacttc taatcatgta ggaaatggtg
4321 agatatctcc agtagaacca caagggactt cgggtgccac tcagcaagat actgccaaag
4381 gtgaccaact agaaagagtt tctaatggac ctgtgttaac tctgggtggg tcaccgtcca
4441 caagcagtat gcaagaagcc ccgagtgtgg cgacaccgcc gttgagtggt actgacctgc
4501 ctaacggacc tctagcttca agtttgaatt cagatgtgcc tcagcaacgc ccaagtgtag
4561 ttgtctcacc acattctaca gcccctgtca tacagggggca tcaagtcata gcagttcccc
4621 actcaggacc tagagtgacc ccttctgctc tatcatctga tgctcggtct acaaacggca
4681 cagccgagtg caaaactgta aagaggccgg cagaggataa tgatagggac actgtcccgg
4741 gaatcccaaa taaagtaggg gttagaattg ttacaatcag cgaccccaac aatgctggct
4801 gcagtgcaac catggttgcg gtcccagctg gagcggaccc aagcactgta gcgaaagtag
4861 caatagaaag tgctgctcag caaaagcagc agcatccacc gacctacatg cagagtgtgg
4921 ccccacagaa cactcctatg ccaccttcac cagctgtaca agtgcagggc cagcctagca
4981 gttctcagcc ttctccagtc agtgcgtcca gtcagcatgc agatccagtg agaaaacctg
5041 ggcagaactt catgtgtctg tggcagtctt gtaaaaagtg gtttcagact ccctcacaag
5101 tgttctatca tgcagctact gaacatggag gaaaagatgt gtatccgggg cagtgtcttt
5161 gggaaggctg tgagcctttc caacggcaga ggttctcttt cattacccac ttacaggata
5221 agcactgttc aaaggatgcc ctgcttgcag gattaaagca agatgaacca ggacaagtgg
5281 caaatcaaaa atcttctacc aagcagccca ccgtgggggg cacaggctct gcgcccagag
5341 cccagaaggc cattgcaagc caccccagtg ctgcactcat ggctctgcgg agaggctcaa
5401 ggaacctcgt cttccgggac ttcacagatg aaaaagaggg accaataact aaacacatcc
5461 gactaacagc tgccttaata ttaaaaaata ttggtaaaata ctcagagtgt gggcgcagat
5521 tgttaaagag acatgaaaac aacttatcag tgctcgccat tagtaacatg gaagcttcct
5581 ctacccttgc caaatgcctt tatgaactta attttacagt tcagagtaaa gaacaagaaa
```

TABLE 1-continued

```
5641  aagactcaga aatgctgtag tgaatcctac cccactgaca cagtggggtc tcaaagtcaa
5701  atacatttca catactgtta ctgaagaaag caccaagtct taatggagca gagaccatag
5761  aatgaattat tttgtgtcct ccatgatgct gagaggaaac ttcgtattct gatctctgaa
5821  cgaatcccct tcttttctgt taaaaaaaaa aaatctaaaa aggaaaaaaa aaaaaaaaaa
5881  aacaaaaact gctgtgggat tgtcaaccag cttatctgca ggatgtctcg gatctggcca
5941  atcctgatgg aaactggtgt gatcagaatt ctgtaccatc cacattggaa tatacatgga
6001  atagtgtaaa acctacgtga gcagatgaaa tagaagcatt aaatatttt atctatatcc
6061  aaaaaggagc acattttat atttacagaa ccatttaagc tggtttgaat aacgacagag
6121  tttgagcaca cctatccccc agcttcagag gggccaccaa tatctagctg tggattgtgt
6181  gttttgttta gaatcagtag cttggttttc ttacttgagc caatatattt tcacttattt
6241  attatcataa aaatttacca gtctgaatag atcttgtaaa tatttgtgaa tagaatgaac
6301  actgttcata ccactgcagc cactggagat acatcctgtg gtgtcctaga agcattatcg
6361  gtaggctcta aagttttcta gactttgctg tcaactgtaa gtaattgtga tatattctac
6421  gcagtggatg gatattcttt aaatctgtgt aaatacttct gcaaaggtac tgatgctgta
6481  aagtcaaaca gttttgtgga actgtgattt ttttttttcct cctttttgg tttccttggc
6541  ccccacttgg gtttggtggg gttttgtttt tgttttgttt tgtattatac accttgtaga
6601  actcattttg ctggctgaaa gagtatggaa taatatatct catatgtcat ttttgtagaa
6661  gagaaactat ttggatttcc ttttgttgg tttggttttc cctaacacgt gtccgctgta
6721  cgcattcgtc acgtgcaagc tcagcttgtg cagggttttt tgtatttgta aattggttta
6781  aatacatgga attttataca ggttttctcc tgtgttatat atgcattatg tgcaggtatg
6841  atattttctt cactactttt tctatcttaa tatagtgtgg aattttattg tattattctt
6901  ccattcttaa tactgtacca cattcctgct cagaaactgc tcacttcctt aaattgtctt
6961  ttcccccaag cgtgaaatgt atccacttat aactgcctat tgcctgttct attagcatcc
7021  aaaaatgtgg aaggcctccc aaccaccatt tctgctgtgt ccttaggatg tgcagtaaaa
7081  aaatatagac ctgacagttt atgttataga atggctttat ttactttggt gactgtttat
7141  agttttttaaa taaaagactg aacattttct tgagtccttt atttctgagt atgcttaaga
7201  cattctaaaa tttaaagtct agctgaaggc aaggtcaaac ggtcacctac ttactttata
7261  ctttgtgatt gtagagaaca gaaaggtgca tcatgtgata ggacaccatg gtcacggtag
7321  gaaggagacc aggagaccaa atgttttgtt tacagtagta tgagtagtag ccccagagag
7381  cgagagacag ttagggctcg gttgccttac tgtgtgtccc gcatctatct gactgagagc
7441  tttgtttacc attcgactct aggtttcagt ttaactaatt caggggcagc ttcttggcaa
7501  tgagcttcag tctggacagt tcaaatatct tgattaattt agtaccaaaa agtaatttct
7561  ccccaggggt ctctgtgctc tcagctctaa ctgtaagaaa tgtgtggcga cacccagaac
7621  ttggtattct caggttggtg gcgtttgact tcttcgcctt agcctggggc tgcccagcag
7681  acaccctgag tccaggtacc ttactgtatc cctcaaatat cgccagacta aaggtttcta
7741  agggcagata gttgtagaaa tttatattca ctgtgtttat ctaaaaaaat tgaggttttt
7801  gaaataattt ttgtaacatc actgtttgct tgtcctcaag gtaccttttt ccttccaaag
7861  caggaaatta ccatggtggt tagcctttag tagcagaaac gacaggctta agaaagtggc
7921  ttccatagtc accatcctgt cacctcactg aattgcatcc tgtagatgta gattttgtg
7981  ttaaaatgta taaatgtgtc tttagtgctt ttaagcaatg gtctcagcag aattttctaa
```

TABLE 1-continued

```
8041  atgtatctga cctgacgaaa ccaatttcta gctccccttaa ggcttcccct ccggcagctt
8101  tacctgacta atggataaga cttggtgggt aacgcggttg aagtgctctt gcagtccagg
8161  gcctgcagaa ccctcgcagt cacgaaaagg tgctccttgc tagacagaaa cttgctgact
8221  tccagtattg ttattttgt ctaaagttct gtaaatacaa gctttaatgt tatctttgag
8281  agatctatgt aaataatagt caagaacata gagactgtac aattctgtgt tatatatgtg
8341  cctagtgctc tgttggcact taataaattt aagtaacaa actgatgat catatagtga
8401  aggcatattt ttcttccgac ttgagacagg atatgactat atattaatga gactcaataa
8461  accaagccac acatgaaaac ttgtctcatt acttatagc catgccatgt atgttttta
8521  aactataaaa tgacaataaa actgatttt gaaatgagtg ttttggataa gtgacttctg
8581  tcctgatctt ataccataaa taaagtactg aagacgaaat atgaagctct tacccaaagg
8641  agtagctgct tagaaacaag agtgaagctt gaagatcagc cacacaggcc acctcacact
8701  ttgttcctgt ttatcttacg atacagtaag ggaaggcacc atttagagcc agcttgtgtt
8761  agttaaccac tctcatactg cccaactctt gactgaactc tggcactcaa atacttggag
8821  tgagcttcct tccaaggcca cagaacagag accaaccgaa ttaccagctg gttccatcat
8881  agctagtaaa ctttatctag caacaattc cactccctgc attggtttga aaaaaaaaat
8941  gcaaagagac agtatcaatg tatgtaagtg gattcactaa taatacaacc cactttaag
9001  tattaaagtg gggtgagatg gcttggtct
```

SEQ ID NO: 12 Mouse ARID2 Amino Acid Sequence (NP_780460.3)

```
   1  manstgkapp derrkglafl delrqfhhsr gspfkkipav ggkeldlhgl ytrvttlggf
  61  akvseknqwg eiveefnfpr scsnaafalk qyylryleky ekvhhfgedd devppgnpkp
 121  qlpigaipss ynyqqhsysd ylrqsyglsm dfnspndynk lvlsllsglp nevdfainvc
 181  tllsneskhv mqlekdpkii tlllanagvf ddtlgsfssv fgeewrektd rdfvkfwkdi
 241  vddnevrdli sdrnkahedt pgewiweslf hpprklgind ieggrvlgia vilrnlsfee
 301  snvkllaanr tclrflllsa hshfislrql gldtlgniaa ellldpvdfr tthlmfhtvt
 361  kclmsrdrfl kmrgmeilgn lckaedngvl iceyvdqdsy reiichltlp dvllvtstle
 421  vlymltemgd vactkiakve ksidvlvclv smdaqmfgpd alaavklieh pssshqvlse
 481  irpgaieqvg tqthiasgpa sravvaqhaa pppgiveids ekfacqwlna hfevnpdcsv
 541  sraemyseyl stcsklargg iltstgfykc lrtvfpnhtv krvedstssg qahihvigvk
 601  rralplpiqm yyqqpistp vvrvdavadl sptspagip hgpqaagnhf grtpvtngss
 661  nitatqmsfp vggihtvaqt vsrippnpsv hthqqnspv tvignkapip cevvkatviq
 721  nsvpqtavpv sisvggapaq nsvgqnhsag pqpvtvvnsq tllhhpsvmp gpsplhtvvp
 781  gqvpsgtpvt viqqtvpqsr mfgrvqsipa ctstvsqgqq littspqpmh tssqqtaags
 841  qpqdtviiap pqyvttsasn ivsatsvgnf qvatgqvvti agvpspqpsr vgfqniapkp
 901  lpsqqvspsv vqqpiqqpqq paqqsvvivs gpaqqggaya paihqivlan paalpagqtv
 961  qltgqpnitp ssspspvppt nnqvptamss sstlqsqgpp ptvsqmlsvk rqqqqhspa
1021  apaqqvqvqv qqpqqvqvqv qpqqpsagvg qpapnessli kglllpkrgp stpggklilp
1081  apqippnnna rapspqvvyq vannqaagfg vqgqtpaqql lvgqqnvqlv qsamppaggv
1141  qtvpisnlqi lpgplisnsp atifqgtsgn qvtitvvpnt sfatatvsqg naaqliapag
1201  lsmsgagasa glqvqtlpag qsacttaplp fkgdkiicqk eeeakeatgl hvherkievm
1261  enpscrrgtt ntsngdtses elqvgsllng rkysdsslpp snsgklqset sqcslisngp
1321  slelgengap gkqnsepvdm qdvkgdlkka lvngicdfdk gdgshlskni pnhktsnhvg
```

TABLE 1-continued

```
1381 ngeispvepq gtsgatqqdt akgdqlervs ngpvltlggs pstssmqeap svatpplsgt
1441 dlpngplass lnsdvpqqrp svvvsphsta pvigghqvia vphsgprvtp salsssdarst
1501 ngtaecktvk rpaedndrdt vpgipnkvgv rivtisdpnn agcsatmvav pagadpstva
1561 kvaiesaagq kqqhpptymq svapqntpmp pspavqvqgq psssqpspvs assqhadpvr
1621 kpgqnfmclw qsckkwfqtp sqvfyhaate hggkdvypgq clwegcepfq rqrfsfithl
1681 qdkhcskdal laglkqdepg qvanqksstk qptvggtgsa praqkaiash psaalmalrr
1741 gsrnlvfrdf tdekegpitk hirltaalil knigkysecg rrllkrhenn lsvlaisnme
1801 asstlakcly elnftvqske gekdseml
```

SEQ ID NO: 13 Human BRD7 cDNA Sequence Variant 1 (NM_001173984.2, CDS: from 161 to 2119)

```
   1 gagagggca tcgcgccgcc cggcgcgcgc cgccccctg cctcgcggcg cggggtctcg
  61 cgggccccgc tcccgccctc cgctcgcctg gcccggaccg gaagcggcgc cgcacggcct
 121 gggcctggcg cgggggggcgg gcaccgggc ccggtcggac atgggcaaga agcacaagaa
 181 gcacaagtcg acaaacacc tctacgagga gtatgtagag aagcccttga agctggtcct
 241 caaagtagga gggaacgaag tcaccgaact ctccacgggc agctcggggc acgactccag
 301 cctcttcgaa gacaaaaacg atcatgacaa acacaaggac agaaagcgga aaagagaaa
 361 gaaaggagag aagcagattc caggggaaga aaggggaga aaacggaaa gagttaagga
 421 ggataaaaag aagcgagatc gagaccgggt ggagaatgag gcagaaaaag atctccagtg
 481 tcacgcccct gtgagattag acttgcctcc tgagaagcct ctcacaagct ctttagccaa
 541 acaagaagaa gtagaacaga caccccttca agaagctttg aatcaactga tgagacaatt
 601 gcagagaaaa gatccaagtg ctttcttttc atttcctgtg actgattta ttgctcctgg
 661 ctactccatg atcattaaac acccaatgga ttttagtacc atgaaagaaa agatcaagaa
 721 caatgactat cagtccatag aagaactaaa ggataacttc aaactaatgt gtactaatgc
 781 catgatttac aataaaccag agaccattta ttataaagct gcaaagaagc tgttgcactc
 841 aggaatgaaa attcttagcc aggaaagaat tcagagcctg aagcagagca tagacttcat
 901 ggctgacttg cagaaaaactc gaaagcagaa agatggaaca gacacctcac agagtgggga
 961 ggacggaggc tgctggcaga gagagagaga ggactctgga gatgccgaag cacacgcctt
1021 caagagtccc agcaaagaaa ataaaagaa agcaaagat atgcttgaag ataagtttaa
1081 aagcaataat ttagagagag agcaggagca gcttgaccgc atcgtgaagg aatctggagg
1141 aaagctgacc aggcggcttg tgaacagtca gtgcgaattt gaaagaagaa accagatgg
1201 aacaacgacg ttgggacttc tccatcctgt ggatcccatt gtaggagagc caggctactg
1261 ccctgtgaga ctgggaatga caactggaag acttcagtct ggagtgaata ctttgcaggg
1321 gttcaaagag gataaaagga acaaagtcac tccagtgtta tatttgaatt atgggcccta
1381 cagttcttat gcaccgcatt atgactccac atttgcaaat atcagcaagg atgattctga
1441 tttaatctat tcaacctatg gggaagactc tgatcttcca agtgatttca gcatccatga
1501 gttttggcc acgtgccaag attatccgta tgtcatggca gatagtttac tggatgtttt
1561 aacaaagga gggcattcca ggacctaca agagatggag atgtcattgc ctgaagatga
1621 aggccatact aggacacttg acacagcaaa agaaatggag cagattacag aagtagagcc
1681 accagggcgt ttggactcca gtactcaaga caggctcata gcgctgaaag cagtaacaaa
1741 ttttggcgtt ccagttgaag ttttttgactc tgaagaagct gaaatattcc agaagaaact
1801 tgatgagacc accagattgc tcagggaact ccaggaagcc cagaatgaac gtttgagcac
```

TABLE 1-continued

```
1861  cagaccccct ccgaacatga tctgtctctt gggtccctca tacagagaaa tgcatcttgc
1921  tgaacaagtg accaataatc ttaaagaact tgcacagcaa gtaactccag gtgatatcgt
1981  aagcacgtat ggagttcgaa aagcaatggg gatttccatt ccttcccccg tcatggaaaa
2041  caactttgtg gatttgacag aagacactga agaacctaaa aagacggatg ttgctgagtg
2101  tggacctggt ggaagttgag gctgcctggt atttgattat atattatgta catactttt
2161  cattcttaac ttagaaatgc ttttcagaag atattaaata tttgtaaatt gtgtttttaa
2221  ttaaactttg gaacagcgaa tttggatgtt ccagaggttg gacttgtatt aggtaataaa
2281  gctggacctg ggactcgtga ggaaggaatg tgaaaaaaaa aaaaaaaaa
```

SEQ ID NO: 14 Human BRD7 Amino Acid Sequence Isoform A (NP_001167455.1)
```
  1  mgkkhkkhks dkhlyeeyve kplklvlkvg gnevtelstg ssghdsslfe dkndhdkhkd
 61  rkrkkrkkge kqipgeekgr krrrvkedkk krdrdrvene aekdlqchap vrldlppekp
121  ltsslakqee vegtplgeal nqlmrqlqrk dpsaffsfpv tdfiapgysm iikhpmdfst
181  mkekiknndy qsieelkdnf klmctnamiy nkpetiyyka akkllhsgmk ilsgeriqsl
241  kgsidfmadl qktrkqkdgt dtsqsgedgg cwqreredsg daeahafksp skenkkkdkd
301  mledkfksnn lereqeqldr ivkesggklt rrlvnsqcef errkpdgttt lgllhpvdpi
361  vgepgycpvr lgmttgrlqs gvntlqgfke dkrnkvtpvl ylnygpyssy aphydstfan
421  iskddsdliy stygedsdlp sdfsihefla tcgdypyvma dslldvltkg ghsrtlqeme
481  mslpedeght rtldtakeme qitevepppgr ldsstqdrli alkavtnfgv pvevfdseea
541  eifqkkldet trllrelgea qnerlstrpp pnmicllgps yremhlaeqv tnnlkelagq
601  vtpgdivsty gvrkamgisi pspvmennfv dltedteepk ktdvaecgpg gs
```

SEQ ID NO: 15 Human BRD7 cDNA Sequence Variant 2 (NM_013263.4, CDS: from 161 to 2116)
```
   1  gagaggggca tcgcgccgcc cggcgcgcgc cgccccctg cctcgcggcg cggggtctcg
  61  cgggccccgc tcccgccctc cgctcgcctg gccggaccg gaagcggcgc cgcacggcct
 121  gggcctggcg cggggggcgg gcaccggggc ccggtcggac atgggcaaga agcacaagaa
 181  gcacaagtcg gacaaacacc tctacgagga gtatgtagag aagcccttga agctggtcct
 241  caaagtagga gggaacgaag tcaccgaact ctccacgggc agctcgggc acgactccag
 301  cctcttcgaa gacaaaaacg atcatgacaa acacaaggac agaaagcgga aaagagaaa
 361  gaaaggagag aagcagattc caggggaaga aaagggagaa aaacggagaa gagttaagga
 421  ggataaaaag aagcgagatc gagaccgggt ggagaatgag gcagaaaaag atctccagtg
 481  tcacgcccct gtgagattag acttgcctcc tgagaagcct ctcacaagct ctttagccaa
 541  acaagaagaa gtagaacaga cacccccttca agaagctttg aatcaactga tgagacaatt
 601  gcagagaaaa gatccaagtg ctttcttttc atttcctgtg actgattta ttgctcctgg
 661  ctactccatg atcattaaac acccaatgga ttttagtacc atgaaagaaa agatcaagaa
 721  caatgactat cagtccatag aagaactaaa ggataacttc aaactaatgt gtactaatgc
 781  catgatttac aataaaccag agaccatta ttataaagct gcaaagaagc tgttgcactc
 841  aggaatgaaa attcttagcc aggaaagaat tcagagcctg aagcagagca tagacttcat
 901  ggctgacttg cagaaaactc gaaagcagaa agatggaaca gacacctcac agagtgggga
 961  ggacggaggc tgctggcaga gagagagaga ggactctgga gatgccgaag cacacgcctt
1021  caagagtccc agcaaagaaa ataaaagaa agacaaagat atgcttgaag ataagtttaa
1081  aagcaataat ttagagagag agcaggagca gcttgaccgc atcgtgaagg aatctggagg
1141  aaagctgacc aggcggcttg tgaacagtca gtgcgaattt gaaagaagaa aaccagatgg
```

TABLE 1-continued

```
1201 aacaacgacg ttgggacttc tccatcctgt ggatcccatt gtaggagagc caggctactg 1261 ccctgtgaga ctgggaatga caactggaag acttcagtct ggagtgaata ctttgcaggg 1321 gttcaaagag gataaaagga acaaagtcac tccagtgtta tatttgaatt atgggcccta 1381 cagttcttat gcaccgcatt atgactccac atttgcaaat atcagcaagg atgattctga 1441 tttaatctat tcaacctatg gggaagactc tgatcttcca agtgatttca gcatccatga 1501 gttttggcc acgtgccaag attatccgta tgtcatggca gatagtttac tggatgtttt 1561 aacaaaagga gggcattcca ggaccctaca agagatggag atgtcattgc ctgaagatga 1621 aggccatact aggacacttg acacagcaaa agaatggag attacagaag tagagccacc 1681 agggcgtttg gactccagta ctcaagacag gctcatagcg ctgaaagcag taacaaattt 1741 tggcgttcca gttgaagttt ttgactctga agaagctgaa atattccaga gaaacttga 1801 tgagaccacc agattgctca gggaactcca ggaagcccag aatgaacgtt tgagcaccag 1861 accccctccg aacatgatct gtctcttggg tccctcatac agagaaatgc atcttgctga 1921 acaagtgacc aataatctta aagaacttgc acagcaagta actccaggtg atatcgtaag 1981 cacgtatgga gttcgaaaag caatgggga ttccattcct tccccgtca tggaaaacaa 2041 ctttgtggat ttgacagaag acactgaaga acctaaaaag acggatgttg ctgagtgtgg 2101 acctggtgga agttgaggct gcctggtatt tgattatata ttatgtacat acttttcat 2161 tcttaactta gaaatgcttt tcagaagata ttaaatattt gtaaattgtg ttttaatta 2221 aactttggaa cagcgaattt ggatgttcca gaggttggac ttgtattagg taataaagct 2281 ggacctggga ctcgtgagga aggaatgtga aaaaaaaaa aaaaaaa
```

SEQ ID NO: 16 Human BRD7 Amino Acid Sequence Isoform B (NP_037395.2)
```
  1 mgkkhkkhks dkhlyeeyve kplklvlkvg gnevtelstg ssghdsslfe dkndhdkhkd 61 rkrkkrkkge kqipgeekgr krrrvkedkk krdrdrvene aekdlqchap vrldlppekp 121 ltsslakqee vegtplgeal nqlmrqlqrk dpsaffsfpv tdfiapgysm iikhpmdfst 181 mkekiknndy qsieelkdnf klmctnamiy nkpetiyyka akkllhsgmk ilsgeriqsl 241 kgsidfmadl qktrkqkdgt dtsqsgedgg cwqreredsg daeahafksp skenkkkdkd 301 mledkfksnn lereqeqldr ivkesggklt rrlvnsqcef errkpdgttt lgllhpvdpi 361 vgepgycpvr lgmttgrlqs gvntlqgfke dkrnkvtpvl ylnygpyssy aphydstfan 421 iskddsdliy stygedsdlp sdfsihefla tcgdypyvma dslldvltkg ghsrtlqeme 481 mslpedeght rtldtakeme iteveppgrl dsstqdrlia lkavtnfgvp vevfdseeae 541 ifqkkldett rllrelgeaq nerlstrppp nmicllgpsy remhlaeqvt nnlkelaqqv 601 tpgdivstyg vrkamgisip spvmennfvd ltedteepkk tdvaecgpgg s
```

SEQ ID NO: 17 Mouse BRD7 cDNA Sequence (NM_012047.2, CDS: from 238 to 2193)
```
  1 ggtttgccgg cctctcgccc tctcgccact ggtgtcgcgc ttcggtcgcg tcccgcgcgt 61 ggttttttt ttttctcgtg agggacctcg cgccgccggg cgcgtgccgt ccccctgcct 121 cgcggcgcgg gctctcgcgg gccccgctcc cgccctccgc tcgcctggcc cggaccggaa 181 gcggcgccgc acggcctggg cctggcgcgg gggcgggct ctggggcccg gtcggacatg 241 ggcaagaagc acaagaagca caagtcggac cgccacttct acgaggagta cgtggagaag 301 ccccctgaagc tggtcctcaa agtcgggggg agcgaggtca ccgagctctc cacgggcagc 361 tccgggcacg actccagcct cttcgaagac aagagcgacc atgacaaaca caaggacaga 421 aaacggaaaa agaggaagaa aggcgagaag caggctccgg gggaagagaa gggagaaaa 481 cggagaagag tcaaggagga taaaaagaag cgggatcgag accgtgcaga gaatgaggtg
```

TABLE 1-continued

```
 541  gacagagatc tccagtgtca tgtccctata agattagact tacctcctga gaagcctctt
 601  acaagctcgt tagccaaaca agaagaagta gaacagacac cccttcagga agctttgaat
 661  cagctcatga gacaattgca aagaaaagac ccaagtgctt tcttttcatt tcctgtgacg
 721  gattttattg cgcctggcta ctccatgatt attaaacacc caatggattt tagtaccatg
 781  aaagaaaaga tcaagaataa cgactaccag tccatagaag aactaaagga taacttcaag
 841  ctaatgtgta ctaatgcaat gatttacaat aagccagaga ccatttatta taaagctgca
 901  aagaagctgt tgcactcagg gatgaaaatt ctcagtcagg agagaattca gagcctgaag
 961  cagagtatag acttcatgtc agacttgcag aaaactcgga agcagaaaga acgaacagat
1021  gcctgtcaga gtggggagga cagcggctgc tggcagcgcg agagggaaga ctctggagat
1081  gctgaaacac aggccttcag aagccccgct aaggacaata aaaggaaaga caaagatgtg
1141  cttgaagaca aatggagaag cagcaactca gaaagggagc atgagcagat tgagcgcgtt
1201  gtccaggagt caggaggcaa gctaacacgg cggctggcaa acagtcagtg tgaatttgaa
1261  agaagaaaac cagatgggac aacaacactg gggcttctcc atcctgtgga tcccattgtg
1321  ggagagccag gctactgccc tgtgagattg gggatgacaa ctggaagact gcagtctgga
1381  gtgaacactc tgcagggggtt caaagaggat aaaaggaaca gagtaacccc agtattatac
1441  ttgaattatg gaccctacag ttcttatgcc ccacattatg actctacatt tgccaatatt
1501  agcaaagatg attctgattt aatctactca acatatgggg aagactctga ccttccaaac
1561  aatttcagca tctctgagtt tttggccaca tgccaagatt acccgtatgt tatggcagat
1621  agtttactgg atgttctaac aaaaggagga cattccagga gcctgcagga cttggacatg
1681  tcatctcctg aagatgaagg ccagaccaga gcattggaca cagcaaaaga agcagagatt
1741  acacaaatag agccaacagg gcgtttggag tccagcagtc aggacaggct cacagcactg
1801  caagctgtaa caacctttgg tgctccagct gaagtctttg actccgaaga ggctgaggtg
1861  ttccagagga agcttgatga gacgacaaga ttgctcaggg agctccagga ggcacagaat
1921  gagcgactga gcactaggcc tcctcccaat atgatctgtc tcctgggtcc ttcttacaga
1981  gaaatgtacc ttgctgaaca agtgaccaat aaccctcaaag aactcacaca gcaagtgact
2041  ccaggtgatg ttgtaagcat acacggagtg cgaaaagcaa tggggatttc tgttccttcc
2101  cccatcgtgg gaaacagctt cgtagatttg acaggagagt gtgaagaacc taaggagacc
2161  agcactgctg agtgtgggcc tgacgcgagc tgaactagcc tggtatttga ttctattatg
2221  tacatagttt ttcattctga acttggaggt gcttttcaga agatattaac tatttgtaaa
2281  ttgtgttttta attaagcttt gggacagttc cttttaatgt tccaaagatt ggccttgtat
2341  taggaaataa agctgaacct gggactgtga
```

SEQ ID NO: 18 Mouse BRD7 Amino Acid Sequence (NP_036177.1)
```
  1  mgkkhkkhks drhfyeeyve kplklvlkvg gsevtelstg ssghdsslfe drsdhdkhkd
 61  rkrkkrkkge kqapgeekgr krrrvkedkk krdrdraene vdrdlqchvp irldlppekp
121  ltsslakqee vegtplgeal nqlmrqlqrk dpsaffsfpv tdfiapgysm iikhpmdfst
181  mkekiknndy qsieelkdnf klmctnamiy nkpetiyyka akkllhsgmk ilsgeriqsl
241  kgsidfmsdl qktrkqkert dacqsgedsg cwqreredsg daetqafrsp akdnkrkdkd
301  vledkwrssn sereheqier vvqesggklt rrlansqcef errkpdgttt lgllhpvdpi
361  vgepgycpvr lgmttgrlqs gvntlqgfke dkrnrvtpvl ylnygpyssy aphydstfan
421  iskddsdliy stygedsdlp nnfsisefla tcgdypyvma dslldvltkg ghsrslqdld
481  msspedegqt raldtakeae itqieptgrl esssqdrlta lqavttfgap aevfdseeae
```

TABLE 1-continued

```
    541 vfqrkldett rllrelgeaq nerlstrppp nmicllgpsy remylaeqvt nnlkeltqqv
    601 tpgdvvsihg vrkamgisvp spivgnsfvd ltgeceepke tstaecgpda s
```

SEQ ID NO: 19 Human PHF10 cDNA Sequence Variant 1 (NM_018288.3, CDS: from 80 to 1576)

```
      1 ggcggcggcg gcagcggcgg cggcggccgg gacaaggcgg aggcgacggc ggcggcggcg
     61 gcgcggggcg ctcgggctga tggcggcggc ggccgggccc ggggctgcgc tgtccccgcg
    121 gccgtgcgac agcgacccag ccaccccggg agcgcagtcc ccgaaggatg ataatgaaga
    181 taattcaaat gatgggaccc agccatccaa aaggaggcga atgggctcag gagatagttc
    241 taggagttgt gaaacttcaa gtcaagatct tggttttagt tactatccag cagaaaactt
    301 gatagagtac aaatggccac ctgatgaaac aggagaatac tatatgcttc aagaacaagt
    361 cagtgaatat ttgggtgtga cctcctttaa aaggaaatat ccagatttag agcgacgaga
    421 tttgtctcac aaggagaaac tctacctgag agagctaaat gtcattactg aaactcagtg
    481 cactctaggc ttaacagcat tgcgcagtga tgaagtgatt gatttaatga taaaagaata
    541 tccagccaaa catgctgagt attctgttat tctacaagaa aagaacgtc aacgaattac
    601 agaccattat aaagagtatt cccaaatgca acaacagaat actcagaaag ttgaagccag
    661 taaagtgcct gagtatatta agaaagctgc caaaaaagca gcagaattta atagcaactt
    721 aaaccgggaa cgcatggaag aagaagagc ttattttgac ttgcagacac atgttatcca
    781 ggtacctcaa gggaagtaca agttttgcc aacagagcga acaaaggtca gttcttaccc
    841 agtggctctc atccccggac agttccagga atattataag aggtactcac cagatgagct
    901 gcggtatctg ccattaaaca cagccctgta tgagccccct ctggatcctg agctccctgc
    961 tctagacagt gatggtgatt cagatgatgg cgaagatggt cgaggtgatg agaaacggaa
   1021 aaataaaggc acttcggaca gctcctctgg caatgtatct gaaggggaaa gccctcctga
   1081 cagccaggag gactctttcc agggaagaca gaaatcaaaa gacaaagctg ccactccaag
   1141 aaaagatggt cccaaacgtt ctgtactgtc caagtcagtt cctgggtaca gccaaaggt
   1201 cattccaaat gctatatgtg gaatttgtct gaagggtaag gagtccaaca agaaaggaaa
   1261 ggctgaatca cttatacact gctcccaatg tgagaatagt ggccatcctt cttgcctgga
   1321 tatgacaatg gagcttgttt ctatgattaa gacctaccca tggcagtgta tggaatgtaa
   1381 aacatgcatt atatgtggac aaccccacca tgaagaagaa atgatgttct gtgatatgtg
   1441 tgacagaggt tatcatactt tttgtgtggg ccttggtgct attccatcag gtcgctggat
   1501 ttgtgactgt tgtcagcggg ccccccaac acccaggaaa gtgggcagaa ggggaaaaa
   1561 cagcaaagag ggataaaata gtttttgact ctaatactgt atatgcattt aagtggaata
   1621 tttggtgcca tttacaacat tatttttcatg ccaataaaag attttttttg caaaaaaaaa
   1681 aaaaaaaaaa aa
```

SEQ ID NO: 20 Human PHF10 Amino Acid Sequence Isoform A (NP_060758.2)

```
      1 maaaagpgaa lsprpcdsdp atpgaqspkd dnednsndgt gpskrrrmgs gdssrscets
     61 sqdlgfsyyp aenlieykwp pdetgeyyml gegvseylgv tsfkrkypdl errdlshkek
    121 lylrelnvit etqctlglta lrsdevidlm ikeypakhae ysvilqeker qritdhykey
    181 sqmqqqntqk veaskvpeyi kkaakkaaef nsnlnrerme errayfdlqt hviqvpqgky
    241 kvlptertkv ssypvalipg qfqeyykrys pdelrylpin talyeppldp elpaldsdgd
    301 sddgedgrgd ekrknkgtsd sssgnvsege sppdsqedsf qgrqkskdka atprkdgpkr
    361 svlsksvpgy kpkvipnaic giclkgkesn kkgkaeslih csqcensghp scldmtmelv
```

TABLE 1-continued

```
421  smiktypwqc mecktciicg qphheeemmf cdmcdrgyht fcvglgaips grwicdccqr
481  apptprkvgr rgknskeg
```

SEQ ID NO: 21 Human PHF10 cDNA Sequence Variant 2 (NM_133325.2, CDS: from 80 to 1570)

```
   1  ggcggcggcg gcagcggcgg cggcggccgg gacaaggcgg aggcgacggc ggcggcggcg
  61  gcgcggggcg ctcgggctga tggcggcggc ggccgggccc ggggctgcgc tgtccccgcg
 121  gccgtgcgac agcgacccag ccaccccggg agcgcagtcc ccgaaggatg ataatgaaga
 181  taattcaaat gatgggaccc agccatccaa aaggaggcga atgggctcag gagatagttc
 241  taggagttgt gaaacttcaa gtcaagatct tggttttagt tactatccag cagaaaactt
 301  gatagagtac aaatggccac ctgatgaaac aggagaatac tatatgcttc aagaacaagt
 361  cagtgaatat ttgggtgtga cctcctttaa aaggaaatat ccagagcgac gagatttgtc
 421  tcacaaggag aaactctacc tgagagagct aaatgtcatt actgaaactc agtgcactct
 481  aggcttaaca gcattgcgca gtgatgaagt gattgattta atgataaaag aatatccagc
 541  caaacatgct gagtattctg ttattctaca agaaaaagaa cgtcaacgaa ttacagacca
 601  ttataaagag tattcccaaa tgcaacaaca gaatactcag aaagttgaag ccagtaaagt
 661  gcctgagtat attaagaaag ctgccaaaaa agcagcagaa tttaatagca acttaaaccg
 721  ggaacgcatg gaagaaagaa gagcttattt tgacttgcag acacatgtta tccaggtacc
 781  tcaagggaag tacaaagttt tgccaacaga gcgaacaaag gtcagttctt acccagtggc
 841  tctcatcccc ggacagttcc aggaatatta aagaggtac tcaccagatg agctgcggta
 901  tctgccatta aacacagccc tgtatgagcc ccctctggat cctgagctcc ctgctctaga
 961  cagtgatggt gattcagatg atggcgaaga tggtcgaggt gatgagaaac ggaaaaataa
1021  aggcacttcg acagctcct ctggcaatgt atctgaaggg aaagccctc ctgacagcca
1081  ggaggactct ttccagggaa gacagaaatc aaaagacaaa gctgccactc aagaaaaga
1141  tggtcccaaa cgttctgtac tgtccaagtc agttcctggg tacaagccaa aggtcattcc
1201  aaatgctata tgtggaattt gtctgaaggg taaggagtcc aacaagaaag gaaaggctga
1261  atcacttata cactgctccc aatgtgagaa tagtggccat ccttcttgcc tggatatgac
1321  aatggagctt gtttctatga ttaagaccta cccatggcag tgtatggaat gtaaaacatg
1381  cattatatgt ggacaacccc accatgaaga agaaatgatg ttctgtgata tgtgtgacag
1441  aggttatcat actttttgtg tgggccttgg tgctattcca tcaggtcgct ggatttgtga
1501  ctgttgtcag cgggcccccc caacacccag gaaagtgggc agaaggggga aaaacagcaa
1561  agagggataa aatagttttt gactctaata ctgtatatgc atttaagtgg aatatttggt
1621  gccatttaca acattatttt catgccaata aaagattttt tttgcaaaaa aaaaaaaaa
1681  aaaaaa
```

SEQ ID NO: 22 Human PHF10 Amino Acid Sequence Isoform B (NP_579866.2)

```
   1  maaaagpgaa lsprpcdsdp atpgaqspkd dnednsndgt gpskrrrmgs gdssrscets
  61  sqdlgfsyyp aenlieykwp pdetgeyyml gegvseylgv tsfkrkyper rdlshkekly
 121  lrelnvitet qctlgltalr sdevidlmik eypakhaeys vilgekerqr itdhykeysq
 181  mqqqntqkve askvpeyikk aakkaaefns nlnrermeer rayfdlgthv iqvpqgkykv
 241  lptertkvss ypvalipgqf qeyykryspd elrylpinta lyeppldpel paldsdgdsd
 301  dgedgrgdek rknkgtsdss sgnvsegesp pdsqedsfqg rqkskdkaat prkdgpkrsv
 361  lsksvpgykp kvipnaicgi clkgkesnkk gkaeslihcs qcensghpsc ldmtmelvsm
```

TABLE 1-continued

```
 421 iktypwqcme cktciicgqp hheeemmfcd mcdrgyhtfc vglgaipsgr wicdccgrap
 481 ptprkvgrrg knskeg
```

SEQ ID NO: 23 Mouse PHF10 cDNA Sequence (NM_024250.4, CDS: from 67 to 1560)
```
    1 gcggcggcgg ccgctgggac taggcgaagg cggcgacgac gacggaggcg cggggcgctt
   61 gggctgatgg cagcggccgg gcccggggcg gcgctgtccc cggggcggtg cgacagcgac
  121 ccggcctccc ccggagcgca gtccccaaag gatgataatg aagataacta aatgatggg
  181 acccatccat gtaaaaggag gcgaatgggc tcaggagaca gctcaagaag ttgtgagact
  241 tcaagtcaag atcttagctt cagttactac ccagcagaaa acttaatcga atacaaatgg
  301 ccacctgatg aaacaggaga atactatatg cttcaggagc aagtcagtga atatctgggt
  361 gtgacctcct tcaagcggaa atatccagat ttagagcgac gagatttatc tcacaaggag
  421 aaactatacc tgagagaatt aaacgtcatc acggaaacac agtgcacact gggtttaaca
  481 gcattgcgca gtgatgaagt gattgactta atgataaaag aatatccagc taaacacgct
  541 gaatattcgg ttatcctaca agaaaaggaa cgtcagagaa ttacagatca ttataaagag
  601 tattctcaaa tgcaacaaca gagtactcag aaagtcgaag ccagcaaagt acctgagtac
  661 attaagaaag cagccaagaa ggcagctgag ttcaacagca cttaaaccg ggagcgcatg
  721 gaagaaagaa gagcctattt tgacttacag acacatgtta ccaagtgcc tcaaggaaag
  781 tacaaagtgt tgccgacaga ccgaacgaag gtcagttcct acccagtggc tctcatcccg
  841 ggacagttcc aggagtatta aagaggtac tcaccagatg agcttcggta cttgccatta
  901 aacacagccc tgtatgagcc gcccctggac ccagagctcc cggcactaga tagtgatgga
  961 gactcagatg atggcgaaga tggcggaggg gatgagaagc ggaagaataa aggcacttcg
 1021 gacagctcct caggcaatgt gtctgaagga gacagccccc ctgacagcca ggaggacacc
 1081 ttccacggaa gacagaaatc aaaagacaaa atggccactc aagaaaaga cggctccaaa
 1141 cgttctgtac tgtccaaatc agctcctggg tacaagccaa aggtcattcc aaatgctcta
 1201 tgtggaattt gtctgaaggg taaggagtcc aacaagaaag gaaaggctga atcacttata
 1261 cactgctccc agtgtgataa cagtggccac ccttcttgct tggatatgac catggagctt
 1321 gtttctatga ttaagaccta cccatggcag tgtatggaat gtaagacatg cattatatgt
 1381 ggacagcccc accatgaaga gaaatgatg ttctgtgatg tgtgtgacag aggttatcat
 1441 acttttttgtg tgggccttgg tgctattcct tcaggtcgct ggatttgtga ctgttgtcag
 1501 cgagctcccc caacacccag gaaagtgggc agaagggga aaaacagcaa gaggggtaa
 1561 aataggcttt gaccctcatg tttgggatat ttggtgccaa tttatttaca acactttcat
 1621 ttttatgcca ataaaaactt ttttgaaatt aacgatgacc ttaaa
```

SEQ ID NO: 24 Mouse PHF10 Amino Acid Sequence (NP_077212.3)
```
    1 maaagpgaal spgrcdsdpa spgaqspkdd nednsndgth pckrrrmgsg dssrscetss
   61 qdlsfsyypa enlieykwpp detgeyymlq eqvseylgvt sfkrkypdle rrdlshkekl
  121 ylrelnvite tqctlgltal rsdevidlmi keypakhaey svilgekerq ritdhykeys
  181 qmqqqstqkv easkvpeyik kaakkaaefn snlnrermee rrayfdlqth viqvpqgkyk
  241 vlptdrtkvs sypvalipgq fqeyykrysp delrylpint alyeppldpe lpaldsdgds
  301 ddgedgggde krknkgtsds ssgnvsegds ppdsqedtfh grqkskdkma tprkdgskrs
  361 vlsksapgyk pkvipnalcg iclkgkesnk kgkaesliHc sqcdnsghps cldmtmelvs
  421 miktypwqcm ecktciicgq phheeemmfc dvcdrgyhtf cvglgaipsg rwicdccgra
  481 pptprkvgrr gknskeg
```

TABLE 1-continued

SEQ ID NO: 25 Human KDM6A cDNA Sequence

```
   1  atgaaatcct gcggagtgtc gctcgctacc gccgccgctg ccgccgccgc tttcggtgat
  61  gaggaaaaga aaatggcggc gggaaaagcg agcggcgaga gcgaggaggc gtcccccagc
 121  ctgacagccg aggagaggga ggcgctcggc ggactggaca gccgcctctt gggttcgtg
 181  agatttcatg aagatggcgc caggacgaag gccctactgg gcaaggctgt tcgctgctat
 241  gaatctctaa tcttaaaagc tgaaggaaaa gtggagtctg atttcttttg tcaattaggt
 301  cacttcaacc tcttattgga agattatcca aaagcattat ctgcatacca gaggtactac
 361  agtttacagt ctgactactg gaagaatgct gccttttat atggtcttgg tttggtctac
 421  ttccattata atgcatttca gtgggcaatt aaagcatttc aggaggtgct ttatgttgat
 481  cccagctttt gtcgagccaa ggaaattcat ttacgacttg gcttatgtt caaagtgaac
 541  acagactatg agtctagttt aaagcatttt cagttagctt tggttgactg taatccctgc
 601  actttgtcca atgctgaaat tcaatttcac attgcccact atatgaaac ccagaggaaa
 661  tatcattctg caaagaagc ttatgaacaa cttttgcaga cagagaatct ttctgcacaa
 721  gtaaaagcaa ctgtcttaca acagttaggt tggatgcatc acactgtaga tctcctggga
 781  gataaagcca ccaaggaaag ctatgctatt cagtatctcc aaaagtcctt ggaagcagat
 841  cctaattctg gccagtcctg gtatttcctc ggaaggtgct attcaagtat tgggaaagtt
 901  caggatgcct ttatatctta caggcagtct attgataaat cagaagcaag tgcagataca
 961  tggtgttcaa taggtgtgct atatcagcag caaaatcagc ccatggatgc tttacaggcc
1021  tatatttgtg ctgtacaatt ggaccatggc catgctgcag cctggatgga cctaggcact
1081  ctctatgaat cctgcaacca gcctcaggat gccattaaat gctacttaaa tgcaactaga
1141  agcaaaagtt gtagtaatac ctctgcactt gcagcacgaa ttaagtattt acaggctcag
1201  ttgtgtaacc ttccacaagg tagtctacag aataaaacta aattacttcc tagtattgag
1261  gaggcgtgga gcctaccaat tcccgcagag cttacctcca ggcagggtgc catgaacaca
1321  gcacagcaga atacttctga caattggagt ggtggacatg ctgtgtcaca tcctccagta
1381  cagcaacaag ctcattcatg gtgtttgaca ccacagaaat tacagcattt ggaacagctc
1441  cgcgcaaata gaaataattt aaatccagca cagaaactga tgctggaaca gctggaaagt
1501  cagtttgtct taatgcaaca acaccaaatg agaccaacag gagttgcaca ggtacgatct
1561  actggaattc ctaatgggcc aacagctgac tcatcactgc ctacaaactc agtctctggc
1621  cagcagccac agcttgctct gaccagagtg cctagcgtct ctcagcctgg agtccgtcct
1681  gcctgccctg gcagccttt ggccaatgga cccttttctg caggccatgt tccctgtagc
1741  acatcaagaa cgctgggaag tacagacact attttgatag caataatca tataacagga
1801  agtggaagta atggaaacgt gccttacctg cagcgaaacg cactcactct acctcataac
1861  cgcacaaacc tgaccagcag cgcagaggag ccgtgaaaaa ccaactatc taactccact
1921  cagggcttc acaaaggtca gagttcacat tcggcaggtc ctaatggtga acgacctctc
1981  tcttccactg ggccttccca gcatctccag gcagctggct ctggtattca gaatcagaac
2041  ggacatccca ccctgcctag caattcagta acacagggggg ctgctctcaa tcacctctcc
2101  tctcacactg ctacctcagg tggacaacaa ggcattacct aaccaaaga gagcaagcct
2161  tcaggaaaca tattgacggt gcctgaaaca agcaggcaca ctggagagac acctaacagc
2221  actgccagtg tcgagggact tcctaatcat gtccatcaga tgacggcaga tgctgttttgc
2281  agtcctagcc atggagattc taagtcacca ggtttactaa gttcagacaa tcctcagctc
2341  tctgccttgt tgatgggaaa agccaataac aatgtgggta ctggaacctg tgacaaagtc
```

TABLE 1-continued

```
2401  aataacatcc acccagctgt tcatacaaag actgataact ctgttgcctc ttcaccatct 2461  tcagccattt caacagcaac accttctcca aaatccactg agcagacaac cacaaacagt 2521  gttaccagcc ttaacagccc tcacagtggg ctacacacaa ttaatggaga agggatggaa 2581  gaatctcaga gccccatgaa aacagatctg cttctggtta accacaaacc tagtccacag 2641  atcataccat caatgtctgt gtccatatac cccagctcag cagaagttct gaaggcatgc 2701  aggaatctag gtaaaaatgg cttatctaac agtagcattt tgttggataa atgtccacct 2761  ccaagaccac catcttcacc ataccctccc ttgccaaagg acaagttgaa tccacctaca 2821  cctagtattt acttggaaaa taaacgtgat gctttctttc ctccattaca tcaattttgt 2881  acaaatccga caaccctgt tacagtaata cgtggccttg ctggagctct taagttagac 2941  ctgggacttt tctctactaa aactttggtg gaagctaaca atgaacatat ggtagaagtg 3001  aggacacagt tgttgcagcc agcagatgaa aactgggatc ccactggaac aaagaaaatc 3061  tggcattgtg aaagtaatag atctcatact acaattgcta aatatgcaca gtaccaggcc 3121  tcctcattcc aggaatcatt gagagaagaa aatgaaaaaa gaagtcatca taaagaccac 3181  tcagatagtg aatctacatc gtcagataat tctgggagga ggaggaaagg accctttaaa 3241  accataaagt ttgggaccaa tattgaccta tctgatgaca aaaagtggaa gttgcagcta 3301  catgagctga ctaaacttcc tgcttttgtg cgtgtcgtat cagcaggaaa tcttctaagc 3361  catgttggtc ataccatatt gggcatgaac acagttcaac tatacatgaa agttccaggg 3421  agcagaacac caggtcatca ggaaaataac aacttctgtt cagttaacat aaatattggc 3481  ccaggtgact gtgaatggtt tgttgttcct gaaggttact ggggtgttct gaatgacttc 3541  tgtgaaaaaa ataatttgaa tttcctaatg ggttcttggt ggcccaatct tgaagatctt 3601  tatgaagcaa atgttccagt gtataggttt attcagcgac ctggagattt ggtctggata 3661  aatgcaggca ctgttcattg ggttcaggct attggctggt gcaacaacat tgcttggaat 3721  gttggtccac ttacagcctg ccagtataaa ttggcagtgg aacggtacga atggaacaaa 3781  ttgcaaagtg tgaagtcaat agtacccatg gttcatcttt cctggaatat ggcacgaaat 3841  atcaaggtct cagatccaaa gcttttgaa atgattaagt attgtcttct aagaactctg 3901  aagcaatgtc agacattgag ggaagctctc attgctgcag gaaaagagat tatatggcat 3961  gggcggacaa agaagaacc agctcattac tgtagcattt tgaagtgga ggttttgat 4021  ctgcttttg tcactaatga gagtaattca cgaaagacct acatagtaca ttgccaagat 4081  tgtgcacgaa aaacaagcgg aaacttggaa aactttgtgg tgctagaaca gtacaaaatg 4141  gaggacctga tgcaagtcta tgaccaattt acattagctc ctccattacc atccgcctca 4201  tcttga
```

SEQ ID NO: 26 Human KDM6A Amino Acid Sequence

```
  1  mkscgvslat aaaaaaafgd eekkmaagka sgeseeasps ltaeerealg gldsrlfgfv 61  rfhedgartk allgkavrcy eslilkaegk vesdffcqlg hfnllledyp kalsayqryy 121  slqsdywkna aflyglglvy fhynafqwai kafqevlyvd psfcrakeih lrlglmfkvn 181  tdyesslkhf glalvdcnpc tlsnaeiqfh iahlyetqrk yhsakeayeq llgtenlsaq 241  vkatvlqqlg wmhhtvdllg dkatkesyai qylqkslead pnsgqswyfl grcyssigkv 301  qdafisyrqs idkseasadt wcsigvlyqg qnqpmdalqa yicavqldhg haaawmdlgt 361  lyescnqpqd aikcylnatr skscsntsal aarikylqaq lcnlpqgslq nktkllpsie 421  eawslpipae ltsrqgamnt aqqntsdnws gghayshppv qqqahswclt pqklghleql 481  ranrnnlnpa qklmlegles qfvlmqqhqm rptgvaqvrs tgipngptad sslptnsysg
```

TABLE 1-continued

```
 541  qqpglaltry  psysqpgvrp  acpgqplang  pfsaghvpcs  tsrtlgstdt  ilignnhitg
 601  sgsngnvpyl  qrnaltlphn  rtnitssaee  pwknqlsnst  gglhkggssh  sagpngerpl
 661  sstgpsghlq  aagsgiqnqn  ghptlpsnsv  tqgaalnhls  shtatsggqq  gitltkeskp
 721  sgniltvpet  srhtgetpns  tasveglpnh  vhqmtadavc  spshgdsksp  gllssdnpql
 781  sallmgkann  nvgtgtcdkv  nnihpavhtk  tdnsvassps  saistatpsp  ksteqtttns
 841  vtslnsphsg  lhtingegme  esgspmktdl  llvnhkpspq  iipsmsysiy  pssaevlkac
 901  rnlgknglsn  ssilldkcpp  prppsspypp  lpkdklnppt  psiylenkrd  affpplhqfc
 961  tnpnnpvtvi  rglagalkld  lglfstktiv  eannehmvev  rtqllqpade  nwdptgtkki
1021  whcesnrsht  tiakyaqyqa  ssfqeslree  nekrshhkdh  sdsestssdn  sgrrrkgpfk
1081  tikfgtnidl  sddkkwklql  heltklpafv  rvvsagnlls  hvghtilgmn  tvqlymkvpg
1141  srtpghqenn  nfcsvninig  pgdcewfvvp  egywgvindf  ceknnlnflm  gswwpnledl
1201  yeanvpvyrf  iqrpgdlvwi  nagtvhwvqa  igwcnniawn  vgpltacqyk  laveryewnk
1261  lqsvksivpm  vhlswnmarn  ikvsdpklfe  mikycllrtl  kqcqtlreal  iaagkeiiwh
1321  grtkeepahy  csicevevfd  llfvtnesns  rktyivhcqd  carktsgnle  nfvvleqykm
1381  edlmqvydqf  tlapplpsas  s
SEQ ID NO: 27 Mouse KDM6A cDNA Sequence
   1  atgaaatcct  gcggagtgtc  gctcgctacc  gccgccgccg  ccgccgccgc  cgccgctttc
  61  ggtgatgagg  aaaagaaaat  ggcggcggga  aaagcgagcg  gcgagagcga  ggaggcgtcc
 121  cccagcctga  cagcggagga  gagggaggcc  ctcggcggac  tggacagccg  ccttttcggg
 181  ttcgtgaggt  ttcatgaaga  tggcgccagg  atgaaggccc  tgctgggcaa  ggctgttcgc
 241  tgctacgaat  ctctaatctt  aaaagctgaa  gggaaagtgg  agtctgattc  cttttgtcaa
 301  ttaggtcact  tcaacctctt  attggaagat  atccaaaaag  cattatctgc  ataccagagg
 361  tactacagtt  tacagtctga  ttactggaag  aatgctgcct  ttttatatgg  tcttggtttg
 421  gtctacttcc  attacaatgc  atttcagtgg  gctattaaag  catttcagga  ggtgctttat
 481  gtcgatccca  gcttttgtcg  agccaaggaa  attcatttac  gacttgggct  tatgttcaaa
 541  gtgaacacag  actatgagtc  tagtttaaag  cattttcagt  tagctttggt  tgactgtaat
 601  ccctgcactt  tgtccaatgc  tgaaattcag  tttcacattg  cccacttata  tgaaacccag
 661  aggaagtatc  attctgcaaa  agaagcttat  gagcaacttt  tgcagacaga  aaacctttct
 721  gcacaagtaa  aagcaactat  tttacaacaa  ttaggttgga  tgcatcacac  tgtggatctc
 781  ctgggagata  aggccaccaa  ggaaagttat  gctattcagt  atctccagaa  gtccttggaa
 841  gcagatccaa  attctggcca  gtcctggtat  ttccttggaa  ggtgctattc  aagtattggg
 901  aaagttcagg  atgcctttat  atcttacagg  caatctattg  ataaatcaga  agcaagtgca
 961  gatacatggt  gttcaatagg  tgtgctctat  aacagcaaa  tcagcctat  ggatgctttg
1021  caagcttata  tttgtgctgt  acaattggac  cacggtcatg  ctgcagcctg  gatggatcta
1081  ggcactctct  atgaatcctg  caaccaacct  caggatgcta  ttaaatgcta  tttaaatgca
1141  actagaagca  aaaattgtag  taatacctct  ggacttgcag  cacgaattaa  gtatttacag
1201  gctcagttgt  gtaaccttcc  acaaggtagt  ctacagaata  aaactaaatt  acttcctagt
1261  attgaggagg  catggagcct  accaatcccc  gcagagctta  cctccaggca  gggtgccatg
1321  aacacagcac  agcagaatac  ttctgataat  tggagtggtg  gcaatgcacc  acctccagta
1381  gaacaacaaa  ctcattcatg  gtgtttgaca  ccacagaaat  tacagcactt  ggaacagctc
1441  cgagcaaaca  gaaataattt  aaatccagca  cagaaactaa  tgctggaaca  gctggaaagt
```

TABLE 1-continued

```
1501  cagtttgtct taatgcagca acaccaaatg agacaaacag gagttgcaca ggtacggcct
1561  actggaattc ttaatgggcc aacagttgac tcatcactgc ctacaaactc agtttctggc
1621  cagcagccac agcttcctct gaccagaatg cctagtgtct ctcagcctgg agtccacact
1681  gcctgtccta ggcagacttt ggccaatgga ccctttctg caggccatgt tccctgtagc
1741  acatcaagaa cactgggaag tacagacact gttttgatag caataatca tgtaacagga
1801  agtggaagta atggaaacgt gccttacctg cagcgaaacg cacccactct acctcataac
1861  cgcacaaacc tgaccagcag cacagaggag ccgtggaaaa accaactatc taactccact
1921  caggggcttc acaaaggtcc gagttcacat ttggcaggtc ctaatggtga acgacctcta
1981  tcttccactg ggccttccca gcatctccag gcagctggct ctggtattca gaatcagaat
2041  ggacatccca ccctgcctag caattcagta acacagggg ctgctctcaa tcacctctcc
2101  tctcacactg ctacctcagg tggacaacaa ggcattacct taaccaaaga gagcaagcct
2161  tcaggaaaca cattgacggt gcctgaaaca agcaggcaaa ctggagagac acctaacagc
2221  actgccagtg ttgagggact tcctaatcat gtccatcagg tgatggcaga tgctgtttgc
2281  agtcctagcc atggagattc taagtcacca ggtttactaa gttcagacaa tcctcagctc
2341  tctgccttgt tgatgggaaa agctaataac aatgtgggtc ctggaacctg tgacaaagtc
2401  aataacatcc acccaactgt ccatacaaag actgataatt ctgttgcctc ttccaccatct
2461  tcagccattt ccacagcaac accttctcct aagtccactg aacagacaac cacaaacagt
2521  gttaccagcc ttaacagccc tcacagtggg ctgcacacaa ttaatggaga aggaatggaa
2581  gaatctcaga gccccattaa aacagatctg cttctagtta gccacagacc tagtcctcag
2641  atcataccat caatgtctgt gtccatatat cccagctcag cagaagttct gaaagcttgc
2701  aggaatctag gtaaaaacgg cctgtctaat agtagcattc tgttggataa atgtccgcct
2761  ccaagaccac catcctcacc atacctccc ttgccaaagg acaagttgaa tccacctaca
2821  cctagtattt atttggaaaa taaacgtgat gctttctttc ctccattaca tcaattttgt
2881  acaaacccaa acaaccctgt tacagtaata cgtggccttg ctggagctct taaattagac
2941  ttgggacttt tctctactaa aactttggtg gaagctaaca atgaacatat ggtagaagtg
3001  aggacacagt tgttacaacc agcagatgaa aattgggacc ctactggaac caagaaaatc
3061  tggcactgtg aaagtaatag atctcatact acaattgcta aatatgctca gtaccaggcc
3121  tcctcattcc aagaatcatt gagagaagaa aatgagaaaa gaagtcacca taaagaccac
3181  tcagacagtg aatctacatc atcagataat tctgggaaaa gaagaaaagg acccttaaa
3241  accattaagt ttgggaccaa cattgacctg tctgatgaca aaaagtggaa gttacagcta
3301  catgagctga ctaaacttcc tgccttcgtg agagttgtat ctgcaggaaa tcttttaagc
3361  cacgttggtc atactatact gggcatgaac acagttcaac tatacatgaa agttccagga
3421  agcagaacac caggtcatca agaaaataac aacttctgtt cagttaatat aaatattggc
3481  ccaggtgact gtgaatggtt tgttgttcct gaaggctact ggggtgtttt gaatgacttc
3541  tgtgaaaaaa ataatttgaa tttcttaatg ggttcttggt ggccccaacct tgaagatcta
3601  tatgaagcaa atgttccagt gtataggttt attcagcgac ctggagatct ggtctggata
3661  aatgctggca ctgttcattg ggttcaagct attggctggt gcaacaatat tgcttggaat
3721  gttggtccac ttacagcctg tcagtataag ttagcagtgg aacgttatga atggaacaag
3781  ttgcaaaatg taaagtcaat agtacccatg gttcatcttt cctggaatat ggcacgaaat
3841  atcaaggttt cagatccaaa gcttttttgaa atgattaagt attgtcttct gagaacgctg
```

TABLE 1-continued

```
3901  aagcaatgtc agacattgag ggaagctcta attgctgcag gaaaagagat catatggcac 3961  gggcggacaa aagaagaacc agctcattat tgtagtattt tgtgaggtgga ggttttttgat 4021  ctgcttttg tcactaatga gagtaattct cgaaaaacct acatagtaca ttgccaagat 4081  tgtgcacgaa aaacaagtgg aatctggaa aattttgtgg tgctagaaca gtacaaaatg 4141  gaggatctga tgcaagtcta tgaccaattt acattagtaa gtgaaatcaa catgctcctc 4201  cattaccatc cgcctcatct tgatattgtt ccatggacat taaacatgag accttttctg 4261  ctattcagaa agtaa
```

SEQ ID NO: 28 Mouse KDM6A Amino Acid Sequence
```
   1  mkscgvslat aaaaaaaaaf gdeekkmaag kasgeseeas psltaeerea lggldsrlfg 61  fvrfhedgar mkallgkavr cyeslilkae gkvesdffcq lghfnllled ypkalsayqr 121  yyslqsdywk naaflyglgl vyfhynafqw aikafqevly vdpsfcrake ihlrlglmfk 181  vntdyesslk hfglalvdcn pctlsnaeiq fhiahlyetq rkyhsakeay eqllgtenls 241  aqvkatilqg lgwmhhtvdl lgdkatkesy aigylqksle adpnsgqswy flgrcyssig 301  kvqdafisyr qsidkseasa dtwcsigvly qqqnqpmdal qayicavgld hghaaawmdl 361  gtlyescnqp qdaikcylna trskncsnts glaarikylq aglcnlpqgs lqnktkllps 421  ieeawslpip aeltsrqgam ntaqqntsdn wsggnapppv eqgthswclt pqklghleql 481  ranrnnlnpa qklmlegles qfvlmqqhqm rqtgvaqvrp tgilngptvd sslptnsysg 541  qqpqlpltrm psysqpgvht acprqtlang pfsaghvpcs tsrtlgstdt vlignnhvtg 601  sgsngnvpyl qrnaptlphn rtnitsstee pwknqlsnst qglhkgpssh lagpngerpl 661  sstgpsghlq aagsgiqnqn ghptlpsnsv tqgaalnhls shtatsggqq gitltkeskp 721  sgntltvpet srqtgetpns tasveglpnh vhqvmadavc spshgdsksp gllssdnpql 781  sallmgkann nvgpgtcdkv nnihptvhtk tdnsvassps saistatpsp ksteqtttns 841  vtslnsphsg lhtingegme esgspiktdl llvshrpspq iipsmsysiy pssaevlkac 901  rnlgknglsn ssilldkcpp prppsspypp lpkdklnppt psiylenkrd affpplhqfc 961  tnpnnpvtvi rglagalkld lglfstktiv eannehmvev rtqllqpade nwdptgtkki 1021  whcesnrsht tiakyaqyqa ssfqeslree nekrshhkdh sdsestssdn sgkrrkgpfk 1081  tikfgtnidl sddkkwklql heltklpafv rvvsagnlls hvghtilgmn tvqlymkvpg 1141  srtpghqenn nfcsvninig pgdcewfvvp egywgvindf ceknnlnflm gswwpnledl 1201  yeanvpvyrf iqrpgdlvwi nagtvhwvqa igwcnniawn vgpltacqyk laveryewnk 1261  lqnvksivpm vhlswnmarn ikvsdpklfe mikycllrtl kqcqtlreal iaagkeiiwh 1321  grtkeepahy csicevevfd llfvtnesns rktyivhcqd carktsgnle nfvvleqykm 1381  edlmqvydqf tivseinmll hyhpphldiv pwtlnmrpfl lfrk
```

SEQ ID NO: 29 Human ARID1A cDNA Sequence Variant 1 (NM_006015.4, CDS: from 374 to 7231)
```
   1  cagaaagcgg agagtcacag cggggccagg ccctggggag cggagcctcc accgccccc 61  tcattcccag gcaagggctt gggggaatg agccgggaga gccgggtccc gagcctacag 121  agccgggagc agctgagccg ccggcgcctc ggccgccgcc gccgcctcct cctcctccgc 181  cgccgccagc ccggagcctg agccggcggg gcgggggga gaggagcgag cgcagcgcag 241  cagcggagcc ccgcgaggcc cgccgggcg ggtggggagg gcagcccggg ggactgggcc 301  ccggggcggg gtgggagggg gggagaagac gaagacaggg ccgggtctct ccgcggacga 361  gacagcgggg atcatggccg cgcaggtcgc cccgcgcc gccagcagcc tgggcaaccc 421  gccgccgccg ccgccctcgg agctgaagaa agccgagcag cagcagcggg aggaggcggg
```

TABLE 1-continued

```
 481  gggcgaggcg gcggcggcgg cagcggccga gcgcggggaa atgaaggcag ccgccgggca
 541  ggaaagcgag ggccccgccg tggggccgcc gcagccgctg ggaaaggagc tgcaggacgg
 601  ggccgagagc aatggggggtg gcggcggcgg cggagccggc agcggcggcg ggcccggcgc
 661  ggagccggac ctgaagaact cgaacgggaa cgcgggccct aggcccgccc tgaacaataa
 721  cctcacggag ccgcccggcg gcggcggtgg cggcagcagc gatggggtgg gggcgcctcc
 781  tcactcagcc gcggccgcct tgccgccccc agcctacggc ttcgggcaac cctacggccg
 841  gagcccgtct gccgtcgccg ccgccgcggc cgccgtcttc caccaacaac atggcggaca
 901  acaaagccct ggcctggcag cgctgcagag cggcggcggc gggggcctgg agccctacgc
 961  ggggccccag cagaactctc acgaccacgg cttccccaac caccagtaca actcctacta
1021  ccccaaccgc agcgcctacc ccccgcccgc cccggcctac gcgctgagct ccccgagagg
1081  tggcactccg ggctccggcg cggcggcggc tgccggctcc aagccgcctc cctcctccag
1141  cgcctccgcc tcctcgtcgt cttcgtcctt cgctcagcag cgcttcgggg ccatgggggg
1201  aggcggcccc tccgcggccg gcgggggaac tccccagccc accgccaccc ccaccctcaa
1261  ccaactgctc acgtcgccca gctcggcccg gggctaccag ggctaccccg gggcgactca
1321  cagtggcggg ccccaggacg ggggcgccgg caagggcccg gcggacatgg cctcgcagtg
1381  ttgggggggct gcggcggcgg cagctgcggc ggcggccgcc tcgggagggg cccaacaaag
1441  gagccaccac gcgcccatga gccccgggag cagcggcggc gggggggcagc cgctcgcccg
1501  gacccctcag ccatccagtc caatggatca gatgggcaag atgagacctc agccatatgg
1561  cgggactaac ccatactcgc agcaacaggg acctccgtca ggaccgcagc aaggacatgg
1621  gtaccagggg cagccatacg ggtcccagac cccgcagcgg tacccgatga ccatgcaggg
1681  ccgggcgcag agtgccatgg gcggcctctc ttatacacag cagattcctc cttatggaca
1741  acaaggcccc agcgggtatg gtcaacaggg ccagactcca tattacaacc agcaaagtcc
1801  tcaccctcag cagcagcagc cacccctactc ccagcaacca ccgtcccaga cccctcatgc
1861  ccaaccttcg tatcagcagc agccacagtc tcaaccacca cagctccagt cctctcagcc
1921  tccatactcc cagcagccat cccagcctcc acatcagcag tccccggctc catacccctc
1981  ccagcagtcg acgacacagc agcaccccca gagccagccc cctactcac agccacaggc
2041  tcagtctcct taccagcagc agcaacctca gcagccagca ccctcgacgc tctcccagca
2101  ggctgcgtat cctcagcccc agtctcagca gtcccagcaa actgcctatt cccagcagcg
2161  cttccctcca ccgcaggagc tatctcaaga ttcatttggg tctcaggcat cctcagcccc
2221  ctcaatgacc tccagtaagg gagggcaaga agatatgaac ctgagccttc agtcaagacc
2281  ctccagcttg cctgatctat ctggttcaat agatgacctc cccatgggga cagaaggagc
2341  tctgagtcct ggagtgagca catcagggat ttccagcagc caaggagagc agagtaatcc
2401  agctcagtct cctttctctc ctcatacctc ccctcacctg cctggcatcc gaggccccttc
2461  cccgtcccct gttggctctc ccgccagtgt tgctcagtct cgctcaggac cactctcgcc
2521  tgctgcagtg ccaggcaacc agatgccacc tcggccaccc agtggccagt cggacagcat
2581  catgcatcct tccatgaacc aatcaagcat tgcccaagat cgaggttata tgcagaggaa
2641  ccccccagatg ccccagtaca gttcccccca gccccggctca gccttatctc cgcgtcagcc
2701  ttccggagga cagatacaca caggcatggg ctcctaccag cagaactcca tggggagcta
2761  tggtccccag gggggtcagt atggcccaca aggtggctac cccaggcagc caaactataa
2821  tgccttgccc aatgccaact accccagtgc aggcatggct ggaggcataa accccatggg
```

TABLE 1-continued

```
2881  tgccggaggt caaatgcatg gacagcctgg catcccacct tatggcacac tccctccagg
2941  gaggatgagt cacgcctcca tgggcaaccg gccttatggc cctaacatgg ccaatatgcc
3001  acctcaggtt gggtcaggga tgtgtccccc accaggggggc atgaaccgga aacccaaga
3061  aactgctgtc gccatgcatg ttgctgccaa ctctatccaa aacaggccgc caggctaccc
3121  caatatgaat caaggggggca tgatgggaac tggacctcct tatggacaag ggattaatag
3181  tatggctggc atgatcaacc ctcaggggacc cccatattcc atgggtgaa ccatggccaa
3241  caattctgca gggatggcag ccagcccaga gatgatgggc cttggggatg taaagttaac
3301  tccagccacc aaaatgaaca acaaggcaga tgggacaccc aagacagaat ccaaatccaa
3361  gaaatccagt tcttctacta caaccaatga aagatcacc aagttgtatg agctgggtgg
3421  tgagcctgag aggaagatgt gggtggaccg ttatctggcc ttcactgagg agaaggccat
3481  gggcatgaca aatctgcctg ctgtgggtag gaaacctctg gacctctatc gcctctatgt
3541  gtctgtgaag gagattggtg gattgactca ggtcaacaag aacaaaaat ggcgggaact
3601  tgcaaccaac ctcaatgtgg gcacatcaag cagtgctgcc agctccttga aaagcagta
3661  tatccagtgt ctctatgcct ttgaatgcaa gattgaacgg ggagaagacc ctcccccaga
3721  catctttgca gctgctgatt ccaagaagtc ccagcccaag atccagcctc cctctcctgc
3781  gggatcagga tctatgcagg ggccccagac tccccagtca accagcagtt ccatggcaga
3841  aggaggagac ttaaagccac caactccagc atccacacca cacagtcaga tcccccatt
3901  gccaggcatg agcaggagca attcagttgg gatccaggat gcctttaatg atggaagtga
3961  ctccacattc cagaagcgga attccatgac tccaaaccct gggtatcagc ccagtatgaa
4021  tacctctgac atgatgggggc gcatgtccta tgagccaaat aaggatcctt atggcagcat
4081  gaggaaagct ccagggagtg atcccttcat gtcctcaggg cagggcccca acggcgggat
4141  gggtgacccc tacagtcgtg ctgccggccc tgggctagga aatgtggcga tgggaccacg
4201  acagcactat ccctatggag gtccttatga cagagtgagg acggagcctg gaatagggcc
4261  tgagggaaac atgagcactg ggggccccaca gccgaatctc atgccttcca acccagactc
4321  ggggatgtat tctcctagcc gctaccccc gcagcagcag cagcagcagc agcaacgaca
4381  tgattcctat ggcaatcagt tctccaccca aggcacccct tctggcagcc ccttccccag
4441  ccagcagact acaatgtatc aacagcaaca gcagaattac aagcggccaa tggatggcac
4501  atatggccct cctgccaagc ggcacgaagg ggagatgtac agcgtgccat acagcactgg
4561  gcaggggcag cctcagcagc agcagttgcc cccagcccag ccccagcctg ccagccagca
4621  acaagctgcc cagccttccc ctcagcaaga tgtatacaac cagtatggca atgcctatcc
4681  tgccactgcc acagctgcta ctgagcgccg accagcaggc ggcccccaga ccaatttcc
4741  attccagttt ggccgagacc gtgtctctgc accccctggc accaatgccc agcaaaacat
4801  gccaccacaa atgatgggcg gccccatata ggcatcagct gaggttgctc agcaaggcac
4861  catgtggcag gggcgtaatg acatgaccta taattatgcc aacaggcaga gcacgggctc
4921  tgcccccag ggccccgcct atcatggcgt gaaccgaaca gatgaaatgc tgcacacaga
4981  tcagagggcc aaccacgaag gctcgtggcc ttcccatggc acacgccagc ccccatatgg
5041  tccctctgcc cctgtgcccc ccatgacaag gccccctcca tctaactacc agccccccacc
5101  aagcatgcag aatcacattc ctcaggtatc cagccctgct cccctgcccc ggccaatgga
5161  gaaccgcacc tctcctagca agtctccatt cctgcactct gggatgaaaa tgcagaaggc
5221  aggtcccccca gtacctgcct cgcacatagc acctgcccct gtgcagcccc ccatgattcg
```

TABLE 1-continued

```
5281  gcgggatatc accttcccac ctggctctgt tgaagccaca cagcctgtgt tgaagcagag
5341  gaggcggctc acaatgaaag acattggaac cccggaggca tggcgggtaa tgatgtccct
5401  caagtctggt ctcctggcag agagcacatg ggcattagat accatcaaca tcctgctgta
5461  tgatgacaac agcatcatga ccttcaacct cagtcagctc ccaggggttgc tagagctcct
5521  tgtagaatat ttccgacgat gcctgattga gatctttggc attttaaagg agtatgaggt
5581  gggtgaccca ggacagaaa cgctactgga tcctgggagg ttcagcaagg tgtctagtcc
5641  agctcccatg gagggtgggg aagaagaaga agaacttcta ggtcctaaac tagaagagga
5701  agaagaagag gaagtagttg aaaatgatga ggagatagcc ttttcaggca aggacaagcc
5761  agcttcagag aatagtgagg agaagctgat cagtaagttt gacaagcttc cagtaaagat
5821  cgtacagaag aatgatccat ttgtggtgga ctgctcagat aagcttgggc gtgtgcagga
5881  gtttgacagt ggcctgctgc actggcggat tggtgggggg gacaccactg agcatatcca
5941  gacccacttc gagagcaaga cagagctgct gccttcccgg cctcacgcac cctgcccacc
6001  agcccctcgg aagcatgtga caacagcaga gggtacacca gggacaacag accaggaggg
6061  gcccccacct gatggacctc cagaaaaacg gatcacagcc actatggatg acatgttgtc
6121  tactcggtct agcaccttga ccgaggatgg agctaagagt tcagaggcca tcaaggagag
6181  cagcaagttt ccatttggca ttagcccagc acagagccac cggaacatca agatcctaga
6241  ggacgaaccc cacagtaagg atgagacccc actgtgtacc cttctggact ggcaggattc
6301  tcttgccaag cgctgcgtct gtgtgtccaa taccattcga agcctgtcat ttgtgccagg
6361  caatgacttt gagatgtcca aacacccagg gctgctgctc atcctgggca agctgatcct
6421  gctgcaccac aagcacccag aacggaagca ggcaccacta acttatgaaa aggaggagga
6481  acaggaccaa ggggtgagct gcaacaaagt ggagtggtgg tgggactgct tggagatgct
6541  ccgggaaaac accttggtta cactcgccaa catctcgggg cagttggacc tatctccata
6601  ccccgagagc atttgcctgc ctgtcctgga cggactccta cactgggcag tttgcccttc
6661  agctgaagcc caggacccct tttccaccct gggccccaat gccgtccttt ccccgcagag
6721  actggtcttg gaaaccctca gcaaactcag catccaggac aacaatgtgg acctgattct
6781  ggccacaccc cccttcagcc gcctggagaa gttgtatagc actatggtgc gcttcctcag
6841  tgaccgaaag aacccggtgt gccgggagat ggctgtggta ctgctggcca acctggctca
6901  gggggacagc ctggcagctc gtgccattgc agtgcagaag ggcagtatcg gcaacctcct
6961  gggcttccta gaggacagcc ttgccgccac acagttccag cagagccagg ccagcctcct
7021  ccacatgcag aacccacccct ttgagccaac tagtgtggac atgatgcggc gggctgcccg
7081  cgcgctgctt gccttggcca aggtggacga gaaccactca gagtttactc tgtacgaatc
7141  acggctgttg gacatctcgg tatcaccgtt gatgaactca ttggtttcac aagtcatttg
7201  tgatgtactg tttttgattg gccagtcatg acagccgtgg gacacctccc ccccccgtgt
7261  gtgtgtgcgt gtgtggagaa cttagaaact gactgttgcc ctttatttat gcaaaaccac
7321  ctcagaatcc agtttaccct gtgctgtcca gcttctccct tgggaaaaag tctctcctgt
7381  ttctctctcc tccttccacc tcccctccct ccatcacctc acgcctttct gttccttgtc
7441  ctcaccttac tcccctcagg accctacccc accctctttg aaaagacaaa gctctgccta
7501  catagaagac ttttttttatt ttaaccaaag ttactgttgt ttacagtgag tttggggaaa
7561  aaaaataaaa taaaaatggc tttcccagtc cttgcatcaa cgggatgcca catttcataa
7621  ctgttttttaa tggtaaaaaa aaaaaaaaaa aatacaaaaa aaaattctga aggacaaaaa
```

TABLE 1-continued

```
7681  aggtgactgc tgaactgtgt gtggtttatt gttgtacatt cacaatcttg caggagccaa
7741  gaagttcgca gttgtgaaca gaccctgttc actggagagg cctgtgcagt agagtgtaga
7801  ccctttcatg tactgtactg tacacctgat actgtaaaca tactgtaata ataatgtctc
7861  acatggaaac agaaaacgct gggtcagcag caagctgtag ttttttaaaaa tgttttttagt
7921  taaacgttga ggagaaaaaa aaaaaaggct tttcccccaa agtatcatgt gtgaacctac
7981  aacaccctga cctctttctc tcctccttga ttgtatgaat aaccctgaga tcacctctta
8041  gaactggttt taacctttag ctgcagcggc tacgctgcca cgtgtgtata tatatgacgt
8101  tgtacattgc acatacccct ggatccccac agtttggtcc tcctcccagc tacccctta
8161  tagtatgacg agttaacaag ttggtgacct gcacaaagcg agacacagct atttaatctc
8221  ttgccagata tcgcccctct tggtgcgatg ctgtacaggt ctctgtaaaa agtccttgct
8281  gtctcagcag ccaatcaact tatagtttat ttttttctgg gttttttgttt tgtttttgttt
8341  tctttctaat cgaggtgtga aaaagttcta ggttcagttg aagttctgat gaagaaacac
8401  aattgagatt ttttcagtga taaaatctgc atatttgtat ttcaacaatg tagctaaaac
8461  ttgatgtaaa ttcctccttt ttttccttt ttggcttaat gaatatcatt tattcagtat
8521  gaaatcttta tactatatgt tccacgtgtt aagaataaat gtacattaaa tcttggtaag
8581  actttt
```

SEQ ID NO: 30 Human ARID1A Amino Acid Sequence isoform A (NP_006006.3)

```
   1  maaqvapaaa sslgnppppp pselkkaegq qreeaggeaa aaaaaergem kaaagqeseg
  61  pavgppqplg kelqdgaesn gggggggags gggpgaepdl knsngnagpr palnnnitep
 121  pgggggssd gvgapphsaa aalpppaygf gqpygrspsa vaaaaaavfh qqhggqqspg
 181  laalqsgggg glepyagpqq nshdhgfpnh qynsyypnrs aypppapaya lssprggtpg
 241  sgaaaaagsk pppsssasas sssssfaqqr fgamggggps aagggtpqpt atptlnqllt
 301  spssargyqg ypggdysggp qdggagkgpa dmasqcwgaa aaaaaaaas ggaqqrshha
 361  pmspgssggg gqplartpqp sspmdqmgkm rpqpyggtnp ysqqqgppsg pqqghgypgq
 421  pygsqtpqry pmtmggqraqs amgglsytqq ippygqqgps gygqqgqtpy ynggsphpgq
 481  qqppysqqpp sqtphaqpsy qqqpqsqppq lqssqppysq qpsqpphqqs papypsqqst
 541  tqqhpqsqpp ysqpqaqspy qqqqpqqpap stlsqqaayp qpqsqqsqqt aysqqrfppp
 601  gelsqdsfgs qassapsmts skggqedmnl slqsrpsslp dlsgsiddlp mgtegalspg
 661  vstsgisssq gegsnpagsp fsphtsphlp girgpspspv gspasvaqsr sgplspaavp
 721  gnqmpprpps gqsdsimhps mngssiaqdr gymqrnpqmp qysspqpgsa lsprqpsggq
 781  ihtgmgsyqq nsmgsygpqg gqygpqggyp rqpnynalpn anypsagmag ginpmgaggq
 841  mhgqpgippy gtlppgrmsh asmgnrpygp nmanmppqvg sgmcpppggm nrktqetava
 901  mhvaansiqn rppgypnmnq ggmmgtgppy gqginsmagm inpqgppysm ggtmannsag
 961  maaspemmgl gdvkltpatk mnnkadgtpk teskskksss stttnekitk lyelggeper
1021  kmwvdrylaf teekamgmtn lpavgrkpld lyrlyvsvke iggltqvnkn kkwrelatnl
1081  nvgtsssaas slkkgyiqcl yafeckierg edpppdifaa adskksqpki qppspagsgs
1141  mqgpqtpqst sssmaeggdl kpptpastph sqipplpgms rsnsvgigda fndgsdstfq
1201  krnsmtpnpg yqpsmntsdm mgrmsyepnk dpygsmrkap gsdpfmssgq gpnggmgdpy
1261  sraagpglgn vamgprqhyp yggpydrvrt epgigpegnm stgapqpnlm psnpdsgmys
1321  psryppqqqq qqqqrhdsyg nqfstqgtps gspfpsqqtt myqqqqqnyk rpmdgtygpp
1381  akrhegemys vpystgqgqp qqqqlppaqp qpasqqqaaq pspqqdvynq ygnaypatat
```

TABLE 1-continued

```
1441  aaterrpagg  pqnqfpfqfg  rdrvsappgt  naqqnmppqm  mggpigasae  vaqqgtmwqg
1501  rndmtynyan  rqstgsapqg  payhgvnrtd  emlhtdqran  hegswpshgt  rqppygpsap
1561  vppmtrppps  nyqpppsmqn  hipqvsspap  lprpmenrts  pskspflhsg  mkmqkagppv
1621  pashiapapv  qppmirrdit  fppgsveatq  pvlkgrrrlt  mkdigtpeaw  rvmmslksgl
1681  laestwaldt  inillyddns  imtfnlsqlp  gllellveyf  rrclieifgi  lkeyevgdpg
1741  qrtlldpgrf  skvsspapme  ggeeeeellg  pkleeeeeee  vvendeeiaf  sgkdkpasen
1801  seekliskfd  klpvkivqkn  dpfvvdcsdk  lgrvqefdsg  llhwrigggd  ttehigthfe
1861  sktellpsrp  hapcppaprk  hvttaegtpg  ttdgegpppd  gppekritat  mddmlstrss
1921  tltedgakss  eaikesskfp  fgispaqshr  nikiledeph  skdetplctl  ldwqdslakr
1981  cvcvsntirs  lsfvpgndfe  mskhpgllli  lgklillhhk  hperkqaplt  yekeeeqdqg
2041  vscnkvewww  dclemlrent  lvtlanisgq  ldlspypesi  clpvldgllh  wavcpsaeaq
2101  dpfstlgpna  vlspqrlvle  tlsklsiqdn  nvdlilatpp  fsrleklyst  mvrflsdrkn
2161  pvcremavvl  lanlaggdsl  aaraiavqkg  signllgfle  dslaatqfqq  sgasllhmqn
2221  ppfeptsvdm  mrraaralla  lakvdenhse  ftlyesrlld  isysplmnsl  vsgvicdvlf
2281  ligqs
```

SEQ ID NO: 31 Human ARID1A cDNA Sequence Variant 2 (NM_139135.2, CDS: from 374 to 6580)

```
   1  cagaaagcgg  agagtcacag  cggggccagg  ccctggggag  cggagcctcc  accgcccccc
  61  tcattcccag  gcaagggctt  gggggggaatg  agccgggaga  gccgggtccc  gagcctacag
 121  agccgggagc  agctgagccg  ccggcgcctc  ggccgccgcc  gccgcctcct  cctcctccgc
 181  cgccgccagc  ccggagcctg  agccggcggg  gcggggggga  gaggagcgag  cgcagcgcag
 241  cagcggagcc  ccgcgaggcc  cgccccgggcg  ggtggggagg  gcagcccggg  ggactgggcc
 301  ccggggcggg  gtgggagggg  gggagaagac  gaagacaggg  ccgggtctct  ccgcggacga
 361  gacagcgggg  atcatggccg  cgcaggtcgc  ccccgccgcc  gccagcagcc  tgggcaaccc
 481  gggcgaggcg  gcggcggcgg  cagcggccga  gcgcggggaa  atgaaggcag  ccgccgggca
 541  ggaaagcgag  ggccccgccg  tgggccgcc   gcagccgctg  ggaaaggagc  tgcaggacgg
 601  ggccgagagc  aatggggggtg  gcggcggcgg  cggagccggc  agcggcggcg  ggcccggcgc
 661  ggagccggac  ctgaagaact  cgaacgggaa  cgcgggccct  aggcccgccc  tgaacaataa
 721  cctcacggag  ccgccggcg   gcggcggtgg  cggcagcagc  gatggggtgg  gggcgcctcc
 781  tcactcagcc  gcggccgcct  tgccgccccc  agcctacggc  ttcgggcaac  cctacggccg
 841  gagcccgtct  gccgtcgccg  ccgccgcggc  cgccgtcttc  caccaacaac  atggcggaca
 901  acaaagccct  ggcctggcag  cgctgcagag  cggcggcggc  ggggggcctgg  agccctacgc
 961  ggggccccag  cagaactctc  acgaccacgg  cttccccaac  caccagtaca  actcctacta
1021  ccccaaccgc  agcgcctacc  ccccgcccgc  cccggcctac  gcgctgagct  ccccgagagg
1081  tggcactccg  ggctccggcg  cggcggcggc  tgccggctcc  aagccgcctc  cctcctccag
1141  cgcctccgcc  tcctcgtcgt  cttcgtcctt  cgctcagcag  cgcttcgggg  ccatggggggg
1201  aggcggcccc  tccgcggccg  gcggggggaac  tccccagccc  accgccaccc  ccacccctcaa
1261  ccaactgctc  acgtcgccca  gctcggcccg  gggctaccag  ggctaccccg  ggggcgacta
1321  cagtggcggg  ccccaggacg  ggggcgccgg  caaggcccg   gcggacatgg  cctcgcagtg
1381  ttggggggct  gcggcggcgg  cagctgcggc  ggcggccgcc  tcggagggg   cccaacaaag
1441  gagccaccac  gcgcccatga  gccccgggag  cagcggcggc  gggggggcagc  cgctcgcccg
```

TABLE 1-continued

```
1501  gaccccucag ccatccagtc aatggatca gatgggcaag atgagacctc agccatatgg
1561  cgggactaac ccatactcgc agcaacaggg acctccgtca ggaccgcagc aaggacatgg
1621  gtacccaggg cagccatacg ggtcccagac cccgcagcgg tacccgatga ccatgcaggg
1681  ccgggcgcag agtgccatgg gcggcctctc ttatacacag cagattcctc cttatggaca
1741  acaaggcccc agcgggtatg gtcaacaggg ccagactcca tattacaacc agcaaagtcc
1801  tcaccctcag cagcagcagc caccctactc ccagcaacca ccgtcccaga cccctcatgc
1861  ccaaccttcg tatcagcagc agccacagtc tcaaccacca cagctccagt cctctcagcc
1921  tccatactcc cagcagccat cccagcctcc acatcagcag tccccggctc catacccctc
1981  ccagcagtcg acgacacagc agcaccccca gagccagccc cctactcac agccacaggc
2041  tcagtctcct taccagcagc agcaacctca gcagccagca ccctcgacgc tctcccagca
2101  ggctgcgtat cctcagcccc agtctcagca gtcccagcaa actgcctatt cccagcagcg
2161  cttccctcca ccgcaggagc tatctcaaga ttcatttggg tctcaggcat cctcagcccc
2221  ctcaatgacc tccagtaagg gagggcaaga agatatgaac ctgagccttc agtcaagacc
2281  ctccagcttg cctgatctat ctggttcaat agatgacctc cccatgggga cagaaggagc
2341  tctgagtcct ggagtgagca catcagggat ttccagcagc caaggagagc agagtaatcc
2401  agctcagtct cctttctctc ctcatacctc ccctcacctg cctggcatcc gaggccctc
2461  cccgtccct gttggctctc ccgccagtgt tgctcagtct cgctcaggac cactctcgcc
2521  tgctgcagtg ccaggcaacc agatgccacc tcggccaccc agtgccagt cggacagcat
2581  catgcatcct tccatgaacc aatcaagcat tgcccaagat cgaggttata tgcagaggaa
2641  cccccagatg ccccagtaca gttcccccca gcccggctca gccttatctc cgcgtcagcc
2701  ttccggagga cagatacaca caggcatggg ctcctaccag cagaactcca tggggagcta
2761  tggtccccag gggggtcagt atggcccaca aggtggctac cccaggcagc caaactataa
2821  tgccttgccc aatgccaact accccagtgc aggcatggct ggaggcataa accccatggg
2881  tgccggaggt caaatgcatg acagcctgg catcccacct tatggcacac tccctccagg
2941  gaggatgagt cacgcctcca tgggcaaccg gccttatggc cctaacatgg ccaatatgcc
3001  acctcaggtt gggtcaggga tgtgtccccc accaggggc atgaaccgga aacccaaga
3061  aactgctgtc gccatgcatg ttgctgccaa ctctatccaa acaggccgc caggctaccc
3121  caatatgaat caaggggca tgatgggaac tggacctcct tatggacaag ggattaatag
3181  tatggctggc atgatcaacc ctcaggacc cccatattcc atgggtggaa ccatggccaa
3241  caattctgca gggatggcag ccagcccaga gatgatgggc cttggggatg taaagttaac
3301  tccagccacc aaaatgaaca acaaggcaga tggacacccc aagacagaat ccaaatccaa
3361  gaaatccagt tcttctacta caaccaatga aagatcacc aagttgtatg agctgggtgg
3421  tgagcctgag aggaagatgt gggtggaccg ttatctggcc ttcactgagg agaaggccat
3481  gggcatgaca aatctgcctg ctgtgggtag gaaacctctg gacctctatc gcctctatgt
3541  gtctgtgaag gagattggtg gattgactca ggtcaacaag aacaaaaat ggcgggaact
3601  tgcaaccaac ctcaatgtgg gcacatcaag cagtgctgcc agctccttga aaaagcagta
3661  tatccagtgt ctctatgcct ttgaatgcaa gattgaacgg ggagaagacc ctccccccaga
3721  catctttgca gctgctgatt ccaagaagtc ccagcccaag atccagcctc cctctcctgc
3781  gggatcagga tctatgcagg ggccccgac tccccagtca accagcagtt ccatggcaga
3841  aggaggagac ttaaagccac caactccagc atccacacca cacagtcaga tccccccatt
```

TABLE 1-continued

```
3901  gccaggcatg agcaggagca attcagttgg gatccaggat gcctttaatg atggaagtga
3961  ctccacattc cagaagcgga attccatgac tccaaaccct gggtatcagc ccagtatgaa
4021  tacctctgac atgatggggc gcatgtccta tgagccaaat aaggatcctt atggcagcat
4081  gaggaaagct ccagggagtg atcccttcat gtcctcaggg cagggcccca acggcgggat
4141  gggtgacccc tacagtcgtg ctgccggccc tgggctagga aatgtggcga tgggaccacg
4201  acagcactat ccctatggag gtccttatga cagagtgagg acggagcctg aatagggcc
4261  tgagggaaac atgagcactg gggccccaca gccgaatctc atgccttcca acccagactc
4321  ggggatgtat tctcctagcc gctaccccc gcagcagcag cagcagcagc agcaacgaca
4381  tgattcctat ggcaatcagt tctccaccca aggcacccct tctggcagcc ccttccccag
4441  ccagcagact acaatgtatc aacagcaaca gcaggtatcc agccctgctc ccctgccccg
4501  gccaatggag aaccgcacct ctcctagcaa gtctccattc ctgcactctg ggatgaaaat
4561  gcagaaggca ggtcccccag tacctgcctc gcacatagca cctgcccctg tgcagccccc
4621  catgattcgg cgggatatca ccttcccacc tggctctgtt gaagccacac agcctgtgtt
4681  gaagcagagg aggcggctca caatgaaaga cattggaacc ccggaggcat ggcgggtaat
4741  gatgtccctc aagtctggtc tcctggcaga gagcacatgg gcattagata ccatcaacat
4801  cctgctgtat gatgacaaca gcatcatgac cttcaacctc agtcagctcc cagggttgct
4861  agagctcctt gtagaatatt tccgacgatg cctgattgag atctttggca ttttaaagga
4921  gtatgaggtg ggtgacccag gacagagaac gctactggat cctgggaggt tcagcaaggt
4981  gtctagtcca gctcccatgg agggtgggga agaagaagaa gaacttctag gtcctaaact
5041  agaagaggaa gaagaagagg aagtagttga aaatgatgag gagatagcct tttcaggcaa
5101  ggacaagcca gcttcagaga atagtgagga gaagctgatc agtaagtttg acaagcttcc
5161  agtaaagatc gtacagaaga atgatccatt tgtggtggac tgctcagata agcttgggcg
5221  tgtgcaggag tttgacagtg gcctgctgca ctggcggatt ggtggggggg acaccactga
5281  gcatatccag acccacttcg agagcaagac agagctgctg ccttcccggc ctcacgcacc
5341  ctgcccacca gcccctcgga agcatgtgac aacagcagag ggtacaccag ggacaacaga
5401  ccaggagggg cccccacctg atggacctcc agaaaaacgg atcacagcca ctatggatga
5461  catgttgtct actcggtcta gcaccttgac cgaggatgga gctaagagtt cagaggccat
5521  caaggagagc agcaagtttc catttggcat tagcccagca cagagccacc ggaacatcaa
5581  gatcctagag gacgaacccc acagtaagga tgagacccca ctgtgtaccc ttctggactg
5641  gcaggattct cttgccaagc gctgcgtctg tgtgtccaat accattcgaa gcctgtcatt
5701  tgtgccaggc aatgactttg agatgtccaa acacccaggg ctgctgctca tcctgggcaa
5761  gctgatcctg ctgcaccaca gcacccagaa acggaagcag gcaccactaa cttatgaaaa
5821  ggaggaggaa caggaccaag gggtgagctg caacaaagtg gagtggtggt gggactgctt
5881  ggagatgctc cgggaaaaca ccttggttac actcgccaac atctcggggc agttggacct
5941  atctccatac cccgagagca tttgcctgcc tgtcctggac ggactcctac actgggcagt
6001  ttgcccttca gctgaagccc aggacccctt ttccaccctg gccccaatg ccgtcctttc
6061  cccgcagaga ctggtcttgg aaaccctcag caaactcagc atccaggaca caatgtgga
6121  cctgattctg gccacacccc ccttcagccg cctggagaag ttgtatagca ctatggtgcg
6181  cttcctcagt gaccgaaaga acccggtgtg ccgggagatg gctgtggtac tgctggccaa
6241  cctggctcag ggggacagcc tggcagctcg tgccattgca gtgcagaagg gcagtatcgg
```

TABLE 1-continued

```
6301  caacctcctg ggcttcctag aggacagcct tgccgccaca cagttccagc agagccaggc
6361  cagcctcctc cacatgcaga acccacccct tgagccaact agtgtggaca tgatgcggcg
6421  ggctgcccgc gcgctgcttg ccttggccaa ggtggacgag aaccactcag agtttactct
6481  gtacgaatca cggctgttgg acatctcggt atcaccgttg atgaactcat tggtttcaca
6541  agtcatttgt gatgtactgt ttttgattgg ccagtcatga cagccgtggg acacctcccc
6601  cccccgtgtg tgtgtgcgtg tgtggagaac ttagaaactg actgttgccc tttatttatg
6661  caaaaccacc tcagaatcca gtttaccctg tgctgtccag cttctccctt gggaaaaagt
6721  ctctcctgtt tctctctcct ccttccacct cccctccctc catcacctca cgccttctgt
6781  ttccttgtcc tcaccttact cccctcagga ccctacccca ccctctttga aaagacaaag
6841  ctctgcctac atagaagact tttttttattt taaccaaagt tactgttgtt tacagtgagt
6901  ttggggaaaa aaaataaaat aaaaatggct ttcccagtcc ttgcatcaac gggatgccac
6961  atttcataac tgtttttaat ggtaaaaaaa aaaaaaaaaa atacaaaaaa aaattctgaa
7021  ggacaaaaaa ggtgactgct gaactgtgtg tggtttattg ttgtacattc acaatcttgc
7081  aggagccaag aagttcgcag ttgtgaacag accctgttca ctggagaggc ctgtgcagta
7141  gagtgtagac cctttcatgt actgtactgt acacctgata ctgtaaacat actgtaataa
7201  taatgtctca catggaaaca gaaaacgctg ggtcagcagc aagctgtagt ttttaaaaat
7261  gtttttagtt aaacgttgag gagaaaaaaa aaaaaggctt ttcccccaaa gtatcatgtg
7321  tgaacctaca acaccctgac ctctttctct cctccttgat tgtatgaata accctgagat
7381  cacctcttag aactggtttt aacctttagc tgcagcggct acgctgccac gtgtgtatat
7441  atatgacgtt gtacattgca catacccttg gatccccaca gtttggtcct cctcccagct
7501  acccctttat agtatgacga gttaacaagt tggtgacctg cacaaagcga gacacagcta
7561  tttaatctct tgccagatat cgcccctctt ggtgcgatgc tgtacaggtc tctgtaaaaa
7621  gtccttgctg tctcagcagc caatcaactt atagtttatt ttttttctggg ttttttgtttt
7681  gttttgtttt ctttctaatc gaggtgtgaa aaagttctag gttcagttga agttctgatg
7741  aagaaacaca attgagattt tttcagtgat aaaatctgca tatttgtatt tcaacaatgt
7801  agctaaaact tgatgtaaat tcctccttt tttccttttt tggcttaatg aatatcattt
7861  attcagtatg aaatctttat actatatgtt ccacgtgtta agaataaatg tacattaaat
7921  cttggtaaga cttt
```

SEQ ID NO: 32 Human ARID1A Amino Acid Sequence isoform B (NP_624361.1)
```
  1  maaqvapaaa sslgnppppp pselkkaegq qreeaggeaa aaaaaergem kaaagqeseg
 61  pavgppqplg kelqdgaesn gggggggags gggpgaepdl knsngnagpr palnnnitep
121  pggggggssd gvgapphsaa aalpppaygf gqpygrspsa vaaaaaavfh qqhggqqspg
181  laalqsgggg glepyagpqq nshdhgfpnh qynsyypnrs aypppapaya lssprggtpg
241  sgaaaaagsk pppsssasas sssssfaqqr fgamggggps aagggtpqpt atptlnqllt
301  spssargyqg ypggdysggp qdggagkgpa dmasqcwgaa aaaaaaaas ggaqqrshha
361  pmspgsgggg gqplartpqp sspmdqmgkm rpqpyggtnp ysqqqgppsg pqqghgypgq
421  pygsqtpqry pmtmggraqs amgglsytqq ippygqqgps gygqqgqtpy ynggsphpqg
481  qqppysqqpp sqtphaqpsy qqqpqsqppq lqssqppysq qpsqpphqqs papypsqqst
541  tqqhpqsqpp ysqpqaqspy qqqqpqqpap stlsqqaayp qpqsqqsqqt aysqqrfppp
601  gelsqdsfgs qassapsmts skggqedmnl slqsrpsslp dlsgsiddlp mgtegalspg
661  vststgisssq gegsnpagsp fsphtsphlp girgpspspv gspasvaqsr sgplspaavp
```

TABLE 1-continued

```
 721  gnqmpprpps gqsdsimhps mngssiaqdr gymqrnpqmp qysspqpgsa lsprqpsggq
 781  ihtgmgsyqq nsmgsygpqg gqygpqggyp rqpnynalpn anypsagmag ginpmgaggq
 841  mhgqpgippy gtlppgrmsh asmgnrpygp nmanmppqvg sgmcpppggm nrktqetava
 901  mhvaansiqn rppgypnmnq ggmmgtgppy gqginsmagm inpqgppysm ggtmannsag
 961  maaspemmgl gdvkltpatk mnnkadgtpk teskskksss stttnekitk lyelggeper
1021  kmwvdrylaf teekamgmtn lpavgrkpld lyrlyvsvke iggltqvnkn kkwrelatnl
1081  nvgtsssaas slkkgyiqcl yafeckierg edpppdifaa adskksqpki qppspagsgs
1141  mqgpqtpqst sssmaeggdl kpptpastph sqipplpgms rsnsvgigda fndgsdstfq
1201  krnsmtpnpg yqpsmntsdm mgrmsyepnk dpygsmrkap gsdpfmssgq gpnggmgdpy
1261  sraagpglgn vamgprqhyp yggpydrvrt epgigpegnm stgapqpnlm psnpdsgmys
1321  psryppqqqq qqqqrhdsyg nqfstqgtps gspfpsqqtt myqqqqvss paplprpmen
1381  rtspskspfl hsgmkmqkag ppvpashiap apvqppmirr ditfppgsve atqpvlkgrr
1441  rltmkdigtp eawrvmmslk sgllaestwa ldtinillyd dnsimtfnls qlpgllellv
1501  eyfrrcliei fgilkeyevg dpgqrtlldp grfskvsspa pmeggeeeee llgpkleeee
1561  eeevvendee iafsgkdkpa senseeklis kfdklpvkiv qkndpfvvdc sdklgrvqef
1621  dsgllhwrig ggdttehiqt hfesktellp srphapcppa prkhvttaeg tpgttdgegp
1681  ppdgppekri tatmddmlst rsstltedga ksseaikess kfpfgispaq shrnikiled
1741  ephskdetpl ctlldwgdsl akrcvcvsnt irslsfvpgn dfemskhpgl llilgklill
1801  hhkhperkqa pltyekeeeq dqgvscnkve wwwdclemlr entivtlani sgqldlspyp
1861  esiclpvldg llhwavcpsa eaqdpfstlg pnavlspqrl vletlsklsi qdnnvdlila
1921  tppfsrlekl ystmvrflsd rknpvcrema vvllanlaqg dslaaraiav qkgsignllg
1981  fledslaatq fqqsgasllh mqnppfepts vdmmrraara llalakvden hseftlyesr
2041  lldisysplm nslvsqvicd vlfligqs
```
SEQ ID NO: 33 Mouse ARID1A cDNA Sequence (NM_001080819.1, CDS: from 1 to 6852)
```
   1  atggccgcgc aggtcgcccc cgccgccgcc agcagcctgg caacccgcc gccgccgccc
  61  tcggagctga agaaagccga gcagcaacag cgggaggagg cgggggcga ggcggcggcg
 121  gcagcggccg agcgcgggga aatgaaggca gccgccgggc aggagagcga gggccccgcc
 181  gtggggccgc cgcagccgct gggaaaggag ctgcaggacg ggccgagag caatgggggt
 241  ggcggcggcg gcggagccgg cagcggcggc gggcccggcg cggagccgga cctgaagaac
 301  tcgaacggga acgcgggccc taggcccgcc ctgaacaata acctcccgga gccgcccggc
 361  ggcggcggcg gcggcggcag cagcagcagc gacggggtgg gggcgcctcc tcactcggcc
 421  gcggccgccc tgccgccccc agcctacggc ttcgggcaag cctacggccg gagcccgtct
 481  gccgtcgccg ccgcggcggc cgccgtcttc caccaacaac atggcggaca caaaagccct
 541  ggcctggcag cgctgcagag cggcggcggc gggggcttgg agccctacgc gggcccag
 601  cagaactcgc acgaccacgg cttccccaac caccagtaca actcctacta ccccaaccgc
 661  agcgcctacc cccgcctccc caggcctac gcgctgagct cccgagagg tggcactccg
 721  ggctccggcg cggcggcggc cgccggctcc aagccgcctc cctcctccag cgcctctgcc
 781  tcctcgtcgt cttcgtcctt cgcacagcag cgcttcgggg ccatgggggg aggcggcccc
 841  tcagcggccg gcgggggaac tcccagcccc accgccaccc ccaccctcaa ccaactgctc
 901  acgtcgccca gctcggcccg tggctaccag ggctaccccg ggggcgacta cggcggcggg
```

TABLE 1-continued

```
 961  ccccaggacg ggggcgcggg caaaggcccg gcggacatgg cctcgcagtg ctgggggggct
1021  gcggcggcgg cggcggcggc ggcagcggcc gtctcgggag gggcccaaca aaggagccac
1081  cacgcgccca tgagccccgg gagcagcggc ggcgggggggc agccgctcgc ccggaccccct
1141  cagtcatcca gtccaatgga tcagatggga aagatgagac ctcagccgta tggtgggact
1201  aacccatact cgcaacaaca gggacctcct tcaggaccgc aacaaggaca tgggtaccca
1261  gggcagccat atgggtccca gactccacag cggtacccca tgaccatgca gggccgggct
1321  cagagtgcca tgggcagcct ctcttatgca cagcagattc caccttatgg ccagcaaggc
1381  cccagtgcgt atggccagca gggccagact ccatactata accagcaaag tcctcatccc
1441  cagcagcagc caccttacgc ccagcaacca ccatcccaga cccctcatgc ccagccttcg
1501  tatcagcagc agccgcagac tcagcaacca cagcttcagt cctctcagcc tccatattcc
1561  cagcagccat cccagcctcc acatcagcag tccccaactc catatccctc ccagcagtcc
1621  accacacaac agcatcccca gagccagccc cctactcac aaccacaggc acagtctccc
1681  taccagcagc agcaacctca gcagccagca tcctcgtcgc tctcccagca ggctgcatat
1741  cctcagcccc agcctcagca gtcccagcaa actgcctatt ccagcagcgc cttccctcca
1801  ccacaggagc tttctcaaga ttcatttggg tctcaggcat cctcagcccc ctcaatgacc
1861  tccagtaagg gagggcaaga agatatgaac ctgagtcttc agtcaaggcc ctccagcttg
1921  cctgatctgt ctggttcaat cgatgatctc cccatgggga cagaaggagc tctgagtcct
1981  ggcgtgagca catcaggat ttccagcagc caaggagagc agagcaatcc agctcagtct
2041  ccctttctc ctcacacctc ccctcacctg cctggcatcc gaggcccgtc cccgtcccct
2101  gttggctctc ctgccagtgt cgcgcagtct cgctcaggac cactctcgcc tgctgcagtg
2161  ccaggcaacc agatgccacc tcggccaccc agtggccagt cagacagcat catgcaccct
2221  tccatgaacc aatcaagcat tgcccaagat cgaggttata tgcagaggaa ccccccagatg
2281  ccccagtaca cttccccctca gcctggctcg gccttatccc cacgtcagcc gtctggagga
2341  cagatgcact cgggcgtggg ctcctaccag cagaactcca tggggagcta cggccccccag
2401  ggcagtcagt atggcccaca aggaggctat cctaggcagc ctaactataa tgccttgccc
2461  aacgccaact accccaatgc aggcatggcc ggaagtatga ccctatgg tgctggaggt
2521  cagatgcatg ggcagcctgg aatcccacct tacggcacac tccctccagg gagaatggct
2581  catgcgtcta tgggcaacag gcccatggc cctaatatgg ccaatatgcc acctcaggtt
2641  gggtcaggga tgtgtcctcc accagggga atgaacagga aaactcaaga gtctgctgtt
2701  gccatgcatg ttgctgccaa ctctatccaa acaggccac caggctaccc aaatatgaat
2761  caaggggggca tgatgggaac tggacctccc tatggacagg ggatcaatag tatggctggc
2821  atgatcaacc ctcagggacc cccatatcct atgggtggaa ccatggccaa caattcagca
2881  gggatggcag ccagcccaga tgatgggc cttggggatg ttaagttaac tcccgccaca
2941  aaaatgaaca acaaggcaga tggaacaccc aagacagaat ccaaatctaa gaaatccagt
3001  tcttctacca ccaccaatga aagatcacc aaattgtatg agttgggtgg tgagcccgag
3061  aggaagatgt gggtggaccg gtacctggcc ttcacagagg agaaggccat gggcatgaca
3121  aatctgcctg ctgtggggag gaagcctctg gacctctatc gcctctatgt gtctgtgaag
3181  gagattggtg ggttgactca ggtcaacaag aacaaaaaat ggcgggaact tgcaaccaac
3241  ctcaatgtgg gtacatcaag cagtgctgcc agctcactga aaaagcagta tatccaatgt
3301  ctctatgcct ttgagtgcaa gatcgagcgt ggagaagacc ctcccccccga tatcttcgca
```

TABLE 1-continued

```
3361  gctgctgact ccaagaagtc ccaacccaag atccagcccc cctctcctgc gggatcaggg
3421  tctatgcagg ggccacaaac tcctcagtca accagcagtt ctatggcaga aggaggagac
3481  ctgaagccac caactccagc atccacacca catagtcaaa ttccccccctt accaggcatg
3541  agcaggagca actcagtcgg aatccaggat gcctttcctg atggaagtga ccccacattc
3601  cagaagcgga attccatgac tccaaaccct gggtaccagc ccagtatgaa tacctctgac
3661  atgatggggc gcatgtccta tgagccaaat aaggatcctt atggcagcat gaggaaagcg
3721  ccaggaagtg atcccttcat gtcctcaggg cagggcccca atggcgggat gggtgatccc
3781  tacagccgtg ctgctggccc tgggctggga agtgtggcga tgggaccacg cagcactat
3841  ccctatggag gtccttacga cagagtgagg acggagcctg aatcgggcc tgaaggaaat
3901  atgggcactg gagcccctca gccaaatctc atgccttcca ccccagattc ggggatgtat
3961  tctcctagcc gctaccccc gcagcagcag cagcaacagc agcaacaaca tgattcctat
4021  ggcaatcaat tctctaccca aggcaccccct tccagcagcc ccttcccag ccagcagacc
4081  acaatgtatc agcagcagca gcagaattat aagaggccaa tggatggcac atatggcccc
4141  cctgccaagc ggcatgaagg ggagatgtac agtgtgccgt acagcgctgg gcaaggccag
4201  cctcaacagc agcagttgcc tgcagctcag tcccagcctg ccagccagcc acaagctgcc
4261  cagccttccc ctcagcagga cgtgtacaac cagtacagca atgcctaccc tgcctccgcc
4321  accgctgcta ctgatcgccg accagcaggc ggcccccaga accaatttcc attccagttt
4381  ggccgagacc gagtctctgc acctcctggt tccagtgccc agcagaacat gccaccacaa
4441  atgatggggt gccccataca ggcatcagct gaggttgctc agcagggcac catgtggcag
4501  gggcgaaatg acatgaccta caattatgcc aacaggcaga acacaggctc tgccacccag
4561  ggccctgcgt atcatggtgt gaaccgaaca gatgaaatgc tccacacaga tcagagggcc
4621  aaccatgaag gcccatggcc ttcccatggc acacgccagc ctccgtatgg tccttcagcc
4681  cctgttcccc ccatgacaag gccccctcca tctaactacc agccccccacc aagcatgccg
4741  aatcacattc ctcaggtatc cagccccgct cccctccccc ggcccatgga aaccgtact
4801  tctcctagca agtctccatt cctgcactct gggatgaaaa tgcaaaaggc gggtccaccg
4861  gtgcctgctt cgcacatagc gcctacccct gtgcagccgc ctatgattcg gcgggatatc
4921  accttcccac ctggctctgt agaggccact cagcctgtgt tgaagcagag aaggcggctc
4981  acaatgaaag acattggaac cccggaggca tggcgggtaa tgatgtccct caagtccggg
5041  ctcctggcag agagcacgtg ggcgttagac accattaaca ttctactgta tgatgacaac
5101  agcattatga ccttcaacct cagccagctc ccaggcttgc tagagctcct tgtggaatat
5161  ttccgtagat gcctaattga aatctttggc attttaaagg agtatgaggt aggggaccca
5221  ggacagagaa cattactaga ccctgggaga ttcaccaagg tgtatagtcc agcccataca
5281  gaggaagaag aggaagaaca ccttgatcct aaactggagg aggaagagga agagggggtt
5341  ggaaatgatg aggagatggc ctttttgggc aaggacaagc catcttcaga gaataatgag
5401  gagaagctag tcagtaagtt tgacaagctt ccggtaaaga tcgtgcagag gaatgaccca
5461  tttgtggtgg actgctcaga taagcttggg cgcgtgcagg agtttgacag tggcctgcta
5521  cactggcgga ttggtggtgg ggataccact gagcatatcc agacccactt tgagagcaag
5581  atagagctgc tgccttcccg gccttatgtg ccctgcccaa cgcccctcg gaaacacctc
5641  acaacagtag agggcacacc agggacaacg gagcaggagg gccccccgcc cgatggcctt
5701  ccagagaaaa ggatcacagc caccatggat gacatgttgt ctacccggtc tagcacattg
```

TABLE 1-continued

| | | | | | |
|---|---|---|---|---|---|
| 5761 | actgatgagg | gggcaaagag | tgcagaggcc | accaaggaaa | gcagcaagtt | tccatttggc |
| 5821 | attagcccag | cacagagcca | ccggaacatc | aaaattttag | aggatgaacc | ccatagtaag |
| 5881 | gatgagaccc | cactgtgtac | ccttctggac | tggcaggatt | cccttgctaa | gcgctgtgtc |
| 5941 | tgtgtctcca | ataccatccg | gagcctgtcg | tttgtgccag | gcaacgactt | tgagatgtcc |
| 6001 | aaacacccag | ggctgctgct | tatcctgggc | aagctgatcc | tgctgcacca | caagcaccca |
| 6061 | gagcggaagc | aggcaccact | aacttatgag | aaggaggagg | aacaggacca | aggggtgagc |
| 6121 | tgtgacaaag | tggagtggtg | gtgggactgc | ttggagatgc | tccgagaaaa | cacgctggtc |
| 6181 | accctcgcca | acatctcggg | gcaattggac | ctatccccat | atcctgagag | catctgcctg |
| 6241 | cctgtcctgg | acggactcct | acactgggca | gtttgccctt | cagctgaagc | ccaggacccc |
| 6301 | ttctcaaccc | taggccccaa | tgccgtcctc | tcccccccaga | gattggtctt | ggaaaccctc |
| 6361 | agcaaactca | gcatccagga | caacaatgtg | gacctgatcc | tggccactcc | ccctttttagc |
| 6421 | cgcctggaga | agttgtatag | taccatggtg | cgcttcctca | gtgaccgaaa | gaacccagtg |
| 6481 | tgccgggaga | tggccgtggt | actgctggca | aatctggccc | aggggacag | cctggcagcc |
| 6541 | cgggccattg | cagtgcagaa | gggcagcatc | ggcaacctcc | tgggtttcct | ggaggacagc |
| 6601 | cttgctgcca | cacagttcca | gcagagccag | gcaagcctcc | tgcatatgca | gaatccaccc |
| 6661 | tttgaaccaa | ctagtgtgga | catgatgcgg | cgggctgccc | gagcactgct | tgccctggcc |
| 6721 | aaggtggatg | agaaccactc | agagttcact | ctgtatgagt | cacggctgtt | ggacatctcc |
| 6781 | gtgtcaccac | tgatgaactc | attggtttca | caagtcattt | gtgatgtact | gttttttgatt |
| 6841 | ggccagtcat | gacagccgtg | ggacacctcc | cctccccgtg | tgtgtgtgag | tgtgtggaga |
| 6901 | acttagaaac | tgactgttgc | cctttattta | tgcaaaacca | cctcagaatc | cagtttaccc |
| 6961 | tgtgctgtcc | agcttctccc | ttgggaaagc | ctctcctgtt | ctctctcctc | cccaccctca |
| 7021 | ctccctcaca | cctttctgtt | ccccatcctc | acctgcttcc | ctcaggaccc | caccctattt |
| 7081 | gaaaagacaa | agctctgcct | acatagaaga | cttttttatt | ttaaccaaag | ttactgttgt |
| 7141 | ttacagtgag | tttggggaaa | aaaatggctt | tcccagtcct | tgcatcaacg | ggatgccaca |
| 7201 | tttcataact | gtttttaatg | gttaaaaaaa | aaaaaaaaaa | aaggaaaaaa | aatacaaaaa |
| 7261 | aaccctgaag | gacaaaggtg | actgctgagc | tgtgtggttt | gtcgctgtcc | attcacaatc |
| 7321 | tcgcaggagc | cgagaagttc | gcagttgtga | gcagaccctg | ttcactggag | aggcctgtgc |
| 7381 | agtagagtgt | agatcctttc | atgtactgta | ctgtacacct | gatactgtaa | acatactgta |
| 7441 | ataataatgt | ctcacatgga | aacgagagaa | gacgctgggt | cagcagcaag | ctgtagtttt |
| 7501 | taaaaatgtt | tttagttaaa | tgttgaggag | aaaaaaaatg | gctttccccc | caaagtatcc |
| 7561 | tgtgtgaacc | tacaacgccc | tgacctcttt | ctctcctcct | tgattgtatg | aatagccctg |
| 7621 | agatcacctc | ttagacctgg | ttttaaccctt | tagctgcagc | ggctgcgctg | ccacgtgtgt |
| 7681 | atatatatga | tgttgtacat | tgcacatacc | cttgaatctc | cacagtttgg | tccccttccc |
| 7741 | agctacccct | ttatagtatg | gcgagttaac | aagttggtga | cctgcacaaa | gcgagacaca |
| 7801 | gctatttaat | ctcttgccag | acattgcccc | tcttggtgca | gtgctctaca | ggtctctgta |
| 7861 | aaaagcccctt | gctgtctcag | cagccaatca | acttacagtt | tatttttttc | tgggtttttg |
| 7921 | ttttgttttg | tttcatttct | aatcgaggtg | tgaaaagtt | ctaggttcag | ttgaagttcc |
| 7981 | tgatgaagaa | acacaattga | gatttttttca | gtgataaaat | ctgcatattt | gtatttcaac |
| 8041 | aatgtagcta | aaaacttgat | gtaaattcct | ccttttttttt | cctttttttgg | cttaatgaat |

TABLE 1-continued

```
8101  atcatttatt cagtatgaaa tctttatact atatgttcca cgtgttaaga ataaatgtac
8161  attaaatctt ggtaa
```

SEQ ID NO: 34 Mouse ARID1A Amino Acid Sequence (NP_001074288.1)
```
   1  maaqvapaaa sslgnppppp selkkaeqqg reeaggeaaa aaaergemka aagqesegpa
  61  vgppqplgke lqdgaesngg gggggagsgg gpgaepdlkn sngnagprpa lnnnlpeppg
 121  gggggssss dgvgapphsa aaalpppayg fgqaygrsps avaaaaaavf hqqhggqqsp
 181  glaalqsggg gglepyagpq qnshdhgfpn hqynsyypnr sayppppqay alssprggtp
 241  gsgaaaaags kpppsssasa sssssfaqq rfgamggggp saagggtpqp tatptlnqll
 301  tspssargyq gypggdyggg pgdggagkgp admasqcwga aaaaaaaaa vsggaqqrsh
 361  hapmspgssg gggqplartp gssspmdgmg kmrpqpyggt npysqqqgpp sgpqqghgyp
 421  gqpygsqtpq rypmtmqgra qsamgslsya gqippygqqg psaygqqgqt pyynqqsphp
 481  qqqppyaqqp psqtphaqps yqqqpqtqqp qlgssqppys qqpsqpphqg sptypsqqs
 541  ttqqhpqsqp pysqpqaqsp yqqqqpqqpa ssslsqqaay pqpqpqqsqq taysqqrfpp
 601  pgelsqdsfg sqassapsmt sskggqedmn lslgsrpssl pdlsgsiddl pmgtegalsp
 661  gvstsgisss ggegsnpaqs pfsphtsphl pgirgpspsp vgspasvaqs rsgplspaav
 721  pgnqmpprpp sgqsdsimhp smngssiaqd rgymqrnpqm pqytspqpgs alsprqpsgg
 781  qmhsgvgsyq qnsmgsygpq gsqygpqggy prqpnynalp nanypnagma gsmnpmgagg
 841  qmhgqpgipp ygtlppgrma hasmgnrpyg pnmanmppqv gsgmcpppgg mnrktqesav
 901  amhvaansiq nrppgypnmn qggmmgtgpp ygqginsmag minpqgppyp mggtmannsa
 961  gmaaspemmg lgdvkltpat kmnnkadgtp kteskskkss ssttttnekit klyelggepe
1021  rkmwvdryla fteekamgmt nlpavgrkpl dlyrlyvsvk eiggltqvnk nkkwrelatn
1081  lnvgtsssaa sslkkgyiqc lyafeckier gedpppdifa aadskksqpk iqppspagsg
1141  smqgpqtpqs tsssmaeggd lkpptpastp hsqipplpgm srsnsvgiqd afpdgsdptf
1201  qkrnsmtpnp gygpsmntsd mmgrmsyepn kdpygsmrka pgsdpfmssg qgpnggmgdp
1261  ysraagpglg svamgprqhy pyggpydrvr tepgigpegn mgtgapqpnl mpstpdsgmy
1321  spsryppqqq qqqqqhdsy gnqfstqgtp ssspfpsqqt tmyqqqqqny krpmdgtygp
1381  pakrhegemy svpysagqgq pqqqqlpaaq sqpasqpqaa gpspqqdvyn qysnaypasa
1441  taatdrrpag gpqnqfpfqf grdrvsappg ssaqqnmppq mmggpigasa evaqqgtmwq
1501  grndmtynya nrqntgsatq gpayhgvnrt demlhtdqra nhegpwpshg trqppygpsa
1561  pvppmtrppp snyqpppsmp nhipqvsspa plprpmenrt spskspflhs gmkmqkagpp
1621  vpashiaptp vqppmirrdi tfppgsveat qpvlkgrrrl tmkdigtpea wrvmmslksg
1681  llaestwald tinillyddn simtfnlsql pgllellvey frrclieifg ilkeyevgdp
1741  gqrtlldpgr ftkvyspaht eeeeeehldp kleeeeeegv gndeemaflg kdkpssenne
1801  eklvskfdkl pvkivqrndp fvvdcsdklg rvgefdsgll hwrigggdtt ehigthfesk
1861  iellpsrpyv pcptpprkhl ttvegtpgtt egegpppdgl pekritatmd dmlstrsstl
1921  tdegaksaea tkesskfpfg ispaqshrni kiledephsk detplctlld wqdslakrcv
1981  cvsntirsls fvpgndfems khpglllilg klillhhkhp erkqapltye keeeqdqgvs
2041  cdkvewwwdc lemlrentiv tlanisgqld lspypesicl pvldgllhwa vcpsaeaqdp
2101  fstlgpnavl spqrlvletl sklsiqdnnv dlilatppfs rleklystmv rflsdrknpv
2161  cremavvlla nlaqgdslaa raiavqkgsi gnllgfleds laatqfqqsq asllhmqnpp
```

TABLE 1-continued

```
2221  feptsvdmmr raarallala kvdenhseft lyesrlldis vsplmnslvs qvicdvlfli
2281  gqs
```

SEQ ID NO: 35 Human ARID1B cDNA Sequence Variant 1 (NM_017519.2, CDS: from 1 to 6711)

```
   1  atggcccata acgcgggcgc cgcggccgcc gccggcaccc acagcgccaa gagcggcggc
  61  tccgaggcgg ctctcaagga gggtggaagc gccgccgcgc tgtcctcctc ctcctcctcc
 121  tccgcggcgg cagcggcggc atcctcttcc tcctcgtcgg gcccgggctc ggccatggag
 181  acggggctgc tccccaacca caaactgaaa accgttggcg aagccccgc cgcgccgccc
 241  caccagcagc accaccacca ccaccatgcc caccaccacc accaccatgc ccaccacctc
 301  caccaccacc acgcactaca gcagcagcta aaccagttcc agcagcagca gcagcagcag
 361  caacagcagc agcagcagca gcagcaacag caacatccca tttccaacaa caacagcttg
 421  ggcggcgcgg gcggcggcgc gcctcagccc ggccccgaca tggagcagcc gcaacatgga
 481  ggcgccaagg acagtgctgc gggcggccag gccgaccccc gggcccgcc gctgctgagc
 541  aagccgggcg acgaggacga cgcgccgccc aagatggggg agccggcggg cggccgctac
 601  gagcacccgg gcttgggcgc cctgggcacg cagcagccgc cggtcgccgt gccggggggc
 661  ggcggcggcc cggcggccgt cccggagttt aataattact atggcagcgc tgcccctgcg
 721  agcggcggcc ccggcggccg cgctgggcct tgcttttgatc aacatggcgg acaacaaagc
 781  cccgggatgg ggatgatgca ctccgcctcc gccgccgccg cgggcccc cggcagcatg
 841  gaccccctgc agaactccca cgaagggtac cccaacagcc agtgcaacca ttatccgggc
 901  tacagccggc ccggcgcggg cggcggcggc ggcggcggcg gcggaggagg aggaggcagc
 961  ggaggaggag gaggaggagg aggagcagga gcaggaggag caggagcggg agctgtggcg
1021  gcggcggccg cggcggcggc ggcagcagca ggaggcggcg gcggcggcgg ctatggggggc
1081  tcgtccgcgg ggtacggggt gctgagctcc cccggcagc agggcggcgg catgatgatg
1141  ggccccgggg gcggcgggc cgcgagcctc agcaaggcgg ccgccggctc ggcggcgggg
1201  ggcttccagc gcttcgccgg ccagaaccag caccccgtcgg gggccacccc gaccctcaat
1261  cagctgctca cctcgcccag ccccatgatg cggagctacg gcggcagcta ccccgagtac
1321  agcagccca gcgcgccgcc gccgccgccg tcgcagcccc agtcccaggc ggcggcggcg
1381  ggggcggcgg cgggcggcca gcaggcggcc gcgggcatgg gcttgggcaa ggacatgggc
1441  gcccagtacg ccgctgccag cccggcctgg gcggccgcgc aacaaaggag tcacccggcg
1501  atgagcccg gcaccccggg accgaccatg ggcagatccc agggcagccc aatggatcca
1561  atggtgatga agagacctca gttgtatggc atgggcagta accctcattc tcagcctcag
1621  cagagcagtc cgtacccagg aggttcctat ggccctccag gcccacagcg gtatccaatt
1681  ggcatccagg gtcggactcc cgggcccatg gccggaatgc agtaccctca gcagcagatg
1741  ccacctcagt atggacagca aggtgtgagt ggttactgcc agcagggcca acagccatat
1801  tacagccagc agccgcagcc ccgcacctc ccaccccagg cgcagtatct gccgtcccag
1861  tcccagcaga ggtaccagcc gcagcaggac atgtctcagg aaggctatgg aactagatct
1921  caacctcctc tggccccgg aaaacctaac catgaagact tgaacttaat acagcaagaa
1981  agaccatcaa gtttaccaga tctgtctggc tccattgatg acctcccac gggaacggaa
2041  gcaactttga gctcagcagt cagtgcatcc gggtccacga gcagccaagg ggatcagagc
2101  aacccggcgc agtcgccttt ctcccccacat gcgtccccctc atctctccag catcccgggg
2161  ggcccatctc cctctcctgt tggctctcct gtaggaagca ccagtctccg atctggccca
```

TABLE 1-continued

```
2221  atctctcctg caagtatccc aggtagtcag atgcctccgc agccacccgg gagccagtca
2281  gaatccagtt cccatcccgc cttgagccag tcaccaatgc cacaggaaag aggttttatg
2341  gcaggcacac aaagaaaccc tcagatggct cagtatggac ctcaacagac aggaccatcc
2401  atgtcgcctc atccttctcc tgggggccaa atgcatgctg aatcagtag ctttcagcag
2461  agtaactcaa gtgggactta cggtccacag atgagccagt atggaccaca aggtaactac
2521  tccagacccc cagcgtatag tggggtgccc agtgcaagct acagcggccc agggcccggt
2581  atgggtatca gtgccaacaa ccagatgcat ggacaagggc caagccagcc atgtggtgct
2641  gtgcccctgg gacgaatgcc atcagctggg atgcagaaca gaccatttcc tggaaatatg
2701  agcagcatga ccccagttc tcctggcatg tctcagcagg agggccagg aatggggccg
2761  ccaatgccaa ctgtgaaccg taaggcacag gaggcagccg cagcagtgat gcaggctgct
2821  gcgaactcag cacaaagcag gcaaggcagt ttccccggca tgaaccagag tggacttatg
2881  gcttccagct ctccctacag ccagcccatg aacaacagct ctagcctgat gaacacgcag
2941  gcgccgccct acagcatggc gcccgccatg gtgaacagct cggcagcatc tgtgggtctt
3001  gcagatatga tgtctcctgg tgaatccaaa ctgcccctgc ctctcaaagc gacgcaaa
3061  gaagaaggca ctccacagcc cgagagcaag tcaaagaagt ccagctcctc caccactact
3121  ggggagaaga tcacgaaggt gtacgagctg gggaatgagc agagagaaa gctctgggtc
3181  gaccgatacc tcaccttcat ggaagagaga ggctctcctg tctcaagtct gcctgccgtg
3241  ggcaagaagc ccctggacct gttccgactc tacgtctgcg tcaaagagat cggggtttg
3301  gcccaggtta ataaaaacaa gaagtggcgt gagctggcaa ccaacctaaa cgttggcacc
3361  tcaagcagtg cagcgagctc cctgaaaaag cagtatattc agtacctgtt tgcctttgag
3421  tgcaagatcg aacgtgggga ggagccccg ccggaagtct tcagcaccgg gacaccaaa
3481  aagcagccca agctccagcc gccatctcct gctaactcgg gatccttgca aggcccacag
3541  acccccagt caactggcag caattccatg gcagaggttc caggtgacct gaagccacct
3601  accccagcct ccaccctca cggccagatg actccaatgc aaggtggaag aagcagtaca
3661  atcagtgtgc acgacccatt ctcagatgtg agtgattcat ccttcccgaa acggaactcc
3721  atgactccaa acgcccccta ccagcagggc atgagcatgc ccgatgtgat gggcaggatg
3781  ccctatgagc ccaacaagga ccccttgggg ggaatgagaa aagtgcctgg aagcagcgag
3841  ccctttatga cgcaaggaca gatgcccaac agcagcatgc aggacatgta caaccaaagt
3901  ccctccggag caatgtctaa cctgggcatg gggcagcgcc agcagttccc ctatggagcc
3961  agttacgacc gaaggcatga accttatggg cagcagtatc caggccaagg ccctccctcg
4021  ggacagccgc cgtatggagg gcaccagccc ggcctgtacc cacagcagcc gaattacaaa
4081  cgccatatgg acggcatgta cgggcccca gccaagcgcc acgagggcga catgtacaac
4141  atgcagtaca gcagccagca gcaggagatg tacaaccagt atggaggctc ctactcgggc
4201  ccggaccgca ggcccatcca gggccagtac ccgtatccct acagcaggga gaggatgcag
4261  ggcccggggc agatccagac acacggaatc ccgcctcaga tgatgggcgg cccgctgcag
4321  tcgtcctcca gtgagggggcc tcagcagaat atgtgggcag cacgcaatga tatgccttat
4381  ccctaccaga caggcagggg ccctggcggc cctacacagg cgcccccta cccaggcatg
4441  aaccgcacag acgatatgat ggtacccgat cagaggataa atcatgagag ccagtggcct
4501  tctcacgtca gccagcgtca gccttatatg tcgtcctcag cctccatgca gcccatcaca
4561  cgcccaccac agccgtccta ccagacgcca ccgtcactgc caaatcacat ctccagggcg
```

TABLE 1-continued

```
4621  cccagcccag cgtccttcca gcgctccctg gagaaccgca tgtctccaag caagtctcct
4681  tttctgccgt ctatgaagat gcagaaggtc atgcccacgg tccccacatc ccaggtcacc
4741  gggccaccac cccaaccacc cccaatcaga agggagatca cctttcctcc tggctcagta
4801  gaagcatcac aaccagtctt gaaacaaagg cgaaagatta cctccaaaga tatcgttact
4861  cctgaggcgt ggcgtgtgat gatgtcccct aaatcaggtc ttttggctga gagtacgtgg
4921  gctttggaca ctattaatat tcttctgtat gatgacagca ctgttgctac tttcaatctc
4981  tcccagttgt ctggatttct cgaacttttta gtcgagtact ttagaaaatg cctgattgac
5041  attttttggaa ttcttatgga atatgaagtg ggagacccca gccaaaaagc acttgatcac
5101  aacgcagcaa ggaaggatga cagccagtcc ttggcagacg attctgggaa agaggaggaa
5161  gatgctgaat gtattgatga cgacgaggaa gacgaggagg atgaggagga agacagcgag
5221  aagacagaaa gcgatgaaaa gagcagcatc gctctgactg ccccggacgc cgctgcagac
5281  ccaaaggaga agcccaagca agccagtaag ttcgacaagc tgccaataaa gatagtcaaa
5341  aagaacaacc tgtttgttgt tgaccgatct gacaagttgg ggcgtgtgca ggagttcaat
5401  agtggccttc tgcactggca gctcggcggg ggtgacacca ccgagcacat tcagactcac
5461  tttgagagca agatggaaat tcctcctcgc aggcgcccac ctccccccctt aagctccgca
5521  ggtagaaaga aagagcaaga aggcaaaggc gactctgaag agcagcaaga gaaaagcatc
5581  atagcaacca tcgatgacgt cctctctgct cggccagggg cattgcctga agacgcaaac
5641  cctgggcccc agaccgaaag cagtaagttt ccctttggta tccagcaagc caaaagtcac
5701  cggaacatca agctgctgga ggacgagccc aggagccgag acgagactcc tctgtgtacc
5761  atcgcgcact ggcaggactc gctggctaag cgatgcatct gtgtgtccaa tattgtccgt
5821  agcttgtcat tcgtgcctgg caatgatgcc gaaatgtcca acatccagg cctggtgctg
5881  atcctgggga agctgattct tcttcaccac gagcatccag agagaaagcg agcaccgcag
5941  acctatgaga aagaggagga tgaggacaag ggggtggcct gcagcaaaga tgagtggtgg
6001  tgggactgcc tcgaggtctt gagggataac acgttggtca cgttggccaa catttccggg
6061  cagctagact tgtctgctta cacggaaagc atctgcttgc caattttgga tggcttgctg
6121  cactggatgg tgtgcccgtc tgcagaggca caagatccct ttccaactgt gggacccaac
6181  tcggtcctgt cgcctcagag acttgtgctg gagaccctct gtaaactcag tatccaggac
6241  aataatgtgg acctgatctt ggccactcct ccatttagtc gtcaggagaa attctatgct
6301  acattagtta ggtacgttgg ggatcgcaaa aacccagtct gtcgagaaat gtccatggcg
6361  cttttatcga accttgccca aggggacgca ctagcagcaa gggccatagc tgtgcagaaa
6421  ggaagcattg gaaacttgat aagcttccta gaggatgggg tcacgatggc ccagtaccag
6481  cagagccagc acaacctcat gcacatgcag ccccgccccc tggaaccacc tagcgtagac
6541  atgatgtgca gggcggccaa ggctttgcta gccatggcca gagtggacga aaaccgctcg
6601  gaattccttt tgcacgaggg ccggttgctg gatatctcga tatcagctgt cctgaactct
6661  ctggttgcat ctgtcatctg tgatgtactg tttcagattg ggcagttatg acataagtga
6721  gaaggcaagc atgtgtgagt gaagattaga gggtcacata taactggctg ttttctgttc
6781  ttgtttatcc agcgtaggaa gaaggaaaag aaaatctttg ctcctctgcc ccattcacta
6841  tttaccaatt gggaattaaa gaaataatta atttgaacag ttatgaaatt aatatttgct
6901  gtctgtgtgt ataagtacat cctttggggt ttttttttttc tcttttttttt aaccaaagtt
6961  gctgtctagt gcattcaaag gtcacttttt gttcttcaca gatctttttta atgttctttc
```

TABLE 1-continued

```
7021  ccatgttgta ttgcattttt gggggaagca aattgacttt aaagaaaaaa gttgtggcaa
7081  aagatgctaa gatgcgaaaa tttcaccaca ctgagtcaaa aaggtgaaaa attatccatt
7141  tcctatgcgt tttactcctc agagaatgaa aaaaactgca tcccatcacc caaagttctg
7201  tgcaatagaa atttctacag atacaggtat aggggctcaa ggaggtatgt cggtcagtag
7261  tcaaaactat gaaatgatac tggtttctcc acaggaatat ggttccatta ggctgggagc
7321  aaaaacaatg ttttttaaga ttgagaatac atacctgaca acgatccgga aactgctcct
7381  caccactccc gtcatgcctg ctgtcggcgt ttgaccttcc acgtgacagt tcttcacaat
7441  tcctttcatc atttttttaaa tattttttt actgcctatg ggctgtgatg tatatagaag
7501  ttgtacatta aacatacccc catttttttc ttttcttttt tttttttttt tttagtacaa
7561  agttttagtt tcttttttcat gatgtggtaa ctacgaagtg atggtagatt taaataattt
7621  tttatttta ttttatatat ttttttcatta gggccatatc tccaaaaaaa gaaagaaaaa
7681  atacaaaaaa caaaaacaaa aaaaaaagag ggtaatgtac aagtttctgt atgtataaag
7741  tcatgctcga tttcaggaga gcagctgatc acaatttgct tcatgaatca aggtgtggaa
7801  atggttatat atggattgat ttagaaaatg gttaccagta cagtcaaaaa agagaaaatg
7861  aaaaaaatac aactaaaagg aagaaacaca acttcaaaga tttttcagtg atgagaatcc
7921  acatttgtat ttcaagataa tgtagtttaa aaaaaaaaaa aagaaaaaaa cttgatgtaa
7981  attcctcctt ttcctctggc ttaatgaata tcatttattc agtataaaat ctttatatgt
8041  tccacatgtt aagaataaat gtacattaaa tcttgttaag cactgtgatg ggtgttcttg
8101  aatactgttc tagtttcctt aaagtggttt cctagtaatc aagttattta caagaaatag
8161  gggaatgcag cagtgtattc acattataaa accctacatt tggaagagac ctttagggggt
8221  tacctacttt agagtgggga gcaacagttt gattttctca aattacttag ctaattagtc
8281  tttctttgaa gcaattaact ctaacgacat tgaggtatga tcattttcag tatttatggg
8341  aggtggctgc tgacccactt gaggtgagat ctcagaagct taactggcct gaaaatgtaa
8401  cattctgcct tttactaact ccatcttagt ttaatcaaag ttcaatctat tccttgtttc
8461  ttctgtgtgc ctcagagtta ttttgcattt agtttactcc accgtgtata atatttatac
8521  tgtgcaatgt taaaaaagaa tctgttatat tgtatgtggt gtacatagtg caaagtgatg
8581  atttctattt cagggcatat tatggttctc atattccttc ctacctggtg cacagtagct
8641  ttttaatact agtcacttct aatttaaact ttctcttcct gggtcattga ctgttactgt
8701  gtaataatcg atttctttga aactgctgca taattatgct gttagtggac ctctacctct
8761  tctcttccct ctcccaatca cagtatactc agaatcccca gcccctcgca tacattgtgt
8821  cggttcacat tactcacagt aatatatgga agagttagac aagaacatgc agttacagtc
8881  attgtgagac gtgactctcc agtgtcacga ggaaaaaaat catctttttct gcaaacagtc
8941  tctcatctgt caactcccac attactgagt caaacagtct tcttacataa caatgcaacc
9001  aaatatatgt tgaattaaag acccatttat aattctgctt taaatacatc tgcttgctaa
9061  gaacagattt cagtgctcca agcttcaaat atggagattt gtaagaggga attcaatatt
9121  attctaattt ctctcttaca gagtacaaat aaaaggtgta tacaaactcc gaacatatcc
9181  agtattccaa ttcctttgtc aatcagaaga gtaaaataat taacaaaaga ctgttgttat
9241  ggtttgcatt gtaaccgata cgcagagtct gaccgttggg caacaagttt ttctatcctg
9301  atgcgcaaca cagtctctag agactaatcc aggaagactt tagcctcctt tccatattct
9361  caccccgaa tcaagattta cagaagccca cgaagaattt acagcctgct tgagatcatc
```

TABLE 1-continued

```
9421  ttgcctataa actgagttat tgctttgtcc taaaaattag tcggttttt ttttctatg
9481  aggctttca gaaatttaca ggatgcccag actttacatg tgtaccaaaa aaaaaaaaa
9541  gataaaaat aaaggtgcaa agaaagttta gtattttgga atggtgctat aaagttgaaa
9601  aaaaaaaa
```

SEQ ID NO: 36 Human ARID1B Amino Acid Sequence isoform A (NP_059989.2)

```
   1  mahnagaaaa agthsaksgg seaalkeggs aaalssssss saaaaaasss sssgpgsame
  61  tgllpnhklk tvgeapaapp hqqhhhhhha hhhhhahhl hhhhalqqql nqfqqqqqqq
 121  qqqqqqqqqq qhpisnnnsl ggagggapqp gpdmeqpqhg gakdsaaggq adppgpplls
 181  kpgdeddapp kmgepaggry ehpglgalgt qqppvavpgg gggpaavpef nnyygsaapa
 241  sggpggragp cfdqhggqqs pgmgmmhsas aaaagapgsm dplqnshegy pnsqcnhypg
 301  ysrpgagggg ggggggggs ggggggggag aggagagava aaaaaaaaaa ggggggggygg
 361  ssagygvlss prqqgggmmm gpggggaasl skaaagsaag gfqrfaggnq hpsgatptln
 421  qlltspspmm rsyggsypey sspsappppp sgpgsgaaaa gaaaggqqaa agmglgkdmg
 481  aqyaaaspaw aaaggrshpa mspgtpgptm grsqgspmdp mvmkrpglyg mgsnphsgpg
 541  qsspypggsy gppgpqrypi giqgrtpgam agmgypqqqm ppgygggggvs gycqqgqqpy
 601  ysggpqpphl ppgagylpsq sggrygpqqd msgegygtrs qpplapgkpn hedlnligge
 661  rpsslpdlsg siddlptgte atlssaysas gstssggdgs npaqspfsph asphlssipg
 721  gpspspvgsp vgsnqsrsgp ispasipgsq mppgppgsgs essshpalsq spmpqergfm
 781  agtgrnpqma gygpggtgps msphpspggq mhagissfqg snssgtygpq msgygpggny
 841  srppaysgvp sasysgpgpg mgisannqmh gggpsgpcga vplgrmpsag mqnrpfpgnm
 901  ssmtpsspgm sqqggpgmgp pmptvnrkaq eaaaavmqaa ansagsrggs fpgmngsglm
 961  assspysgpm nnssslmntq appysmapam vnssaasvgl admmspgesk lplplkadgk
1021  eegtpqpesk skksssstt gekitkvyel gneperklwv dryltfmeer gspvsslpav
1081  gkkpldlfrl yvcvkeiggl aqvnknkkwr elatnlnvgt sssaasslkk gyigylfafe
1141  ckiergeepp pevfstgdtk kgpklgppsp ansgslggpg tpgstgsnsm aevpgdlkpp
1201  tpastphgqm tpmqggrsst isvhdpfsdv sdssfpkrns mtpnapyggg msmpdvmgrm
1261  pyepnkdpfg gmrkvpgsse pfmtqgqmpn ssmgdmyngs psgamsnlgm ggrqqfpyga
1321  sydrrhepyg ggypggggpps ggppygghgp glypqqpnyk rhmdgmygpp akrhegdmyn
1381  mgyssqggem ynqyggsysg pdrrpigggy pypysrermq gpggigthgi ppqmmggplq
1441  ssssegpqqn mwaarndmpy pygnrggpgg ptqappypgm nrtddmmvpd grinhesqwp
1501  shvsgrqpym sssasmqpit rppgpsygtp pslpnhisra pspasfqrsl enrmspsksp
1561  flpsmkmqkv mptvptsqvt gpppqpppir reitfppgsv easgpvlkgr rkitskdivt
1621  peawrvmmsl ksgllaestw aldtinilly ddstvatfnl sqlsgflell veyfrkclid
1681  ifgilmeyev gdpsqkaldh naarkddsqs laddsgkeee daecidddee deedeeedse
1741  ktesdekssi altapdaaad pkekpkgask fdklpikivk knnlfvvdrs dklgrvgefn
1801  sgllhwqlgg gdttehigth feskmeippr rrppplssa grkkeqegkg dseeggeksi
1861  iatiddvlsa rpgalpedan pgpqtesskf pfgiqqaksh rnikllledep rsrdetplct
1921  iahwqdslak rcicvsnivr slsfvpgnda emskhpglvl ilgklillhh ehperkrapq
1981  tyekeededk gvacskdeww wdclevlrdn tivtlanisg gldlsaytes iclpildgll
2041  hwmvcpsaea gdpfptvgpn svlspqrlvl eticklsiqd nnvdlilatp pfsrqekfya
2101  tivryvgdrk npvcremsma llsnlaggda laaraiavqk gsignlisfl edgvtmagyg
```

TABLE 1-continued

```
2161  gsghnlmhmq ppplepppsvd mmcraakall amarvdenrs efllhegrll disisavins
2221  lvasvicdvl fgiggl
```

SEQ ID NO: 37 Human ARID1B cDNA Sequence Variant 2 (NM_020732.3, CDS: from 1 to 6750)

```
   1  atgcccata acgcgggcgc cgcggccgcc gccggcaccc acagcgccaa gagcggcggc
  61  tccgaggcgg ctctcaagga gggtggaagc gccgccgcgc tgtcctcctc ctcctcctcc
 121  tccgcggcgg cagcggcggc atcctcttcc tcctcgtcgg gcccgggctc ggccatggag
 181  acggggctgc tccccaacca caaactgaaa accgttggcg aagccccgc cgcgccgccc
 241  caccagcagc accaccacca ccaccatgcc caccaccacc accaccatgc ccaccacctc
 301  caccaccacc acgcactaca gcagcagcta aaccagttcc agcagcagca gcagcagcag
 361  caacagcagc agcagcagca gcagcaacag caacatccca tttccaacaa caacagcttg
 421  ggcggcgcgg gcggcggcgc gcctcagccc ggccccgaca tggagcagcc gcaacatgga
 481  ggcgccaagg acagtgctgc gggcggccag gccgaccccc gggcccgcc gctgctgagc
 541  aagccgggcg acgaggacga cgcgccgccc aagatggggg agccggcggg cggccgctac
 601  gagcacccgg gcttgggcgc cctgggcacg cagcagccgc cggtcgccgt gccggggggc
 661  ggcggcggcc cggcggccgt cccggagttt aataattact atggcagcgc tgcccctgcg
 721  agcggcggcc ccggcggccg cgctgggcct tgcttttgatc aacatggcgg acaacaaagc
 781  cccgggatgg ggatgatgca ctccgcctcc gccgcgccg ccgggccccc cggcagcatg
 841  gaccccctgc agaactccca cgaagggtac cccaacagcc agtgcaacca ttatccgggc
 901  tacagccggc ccggcgcggg cggcggcggc ggcggcggcg gcggaggagg aggaggcagc
 961  ggaggaggag gaggaggagg aggagcagga gcaggaggag caggagcggg agctgtggcg
1021  gcggcggccg cggcggcggc ggcagcagca ggaggcggcg gcggcggcgg ctatggggc
1081  tcgtccgcgg ggtacggggt gctgagctcc ccccggcagc agggcggcgg catgatgatg
1141  ggccccgggg gcggcgggc cgcgagcctc agcaaggcgg ccgccggctc ggcggcgggg
1201  ggcttccagc gcttcgccgg ccagaaccag cacccgtcgg gggccacccc gaccctcaat
1261  cagctgctca cctcgcccag ccccatgatg cggagctacg gcggcagcta ccccgagtac
1321  agcagcccca gcgcgccgcc gccgccgccg tcgcagcccc agtcccaggc ggcggcggcg
1381  ggggcggcgg cgggcggcca gcaggcggcc gcgggcatgg gcttgggcaa ggacatgggc
1441  gcccagtacg ccgctgccag cccggcctgg gcggccgcgc aacaaaggag tcacccggcg
1501  atgagcccg caccccggg accgaccatg gcagatccc agggcagccc aatggatcca
1561  atggtgatga agagacctca gttgtatggc atgggcagta accctcattc tcagcctcag
1621  cagagcagtc cgtacccagg aggttcctat ggcctccag gcccacgcg tatccaatt
1681  ggcatccagg gtcggactcc cggggccatg gccggaatgc agtaccctca gcagcaggac
1741  tctggagatg ccacatggaa agaaacattc tggttgatgc cacctcagta tggacagcaa
1801  ggtgtgagtg gttactgcca gcagggccaa cagccatatt acagccagca gccgcagccc
1861  ccgcacctcc caccccaggc gcagtatctg ccgtcccagt cccagcagag gtaccagccg
1921  cagcaggaca tgtctcagga aggctatgga actagatctc aacctcctct ggccccccga
1981  aaacctaacc atgaagactt gaacttaata cagcaagaaa gaccatcaag tttaccagat
2041  ctgtctggct ccattgatga cctccccacg ggaacggaag caactttgag ctcagcagtc
2101  agtgcatccg ggtccacgag cagccaaggg gatcagagca cccggcgca gtcgcctttc
2161  tccccacatg cgtcccctca tctctccagc atcccgggggg gcccatctcc ctctcctgtt
```

TABLE 1-continued

```
2221  ggctctcctg taggaagcaa ccagtctcga tctggcccaa tctctcctgc aagtatccca
2281  ggtagtcaga tgcctccgca gccacccggg agccagtcag aatccagttc ccatcccgcc
2341  ttgagccagt caccaatgcc acaggaaaga ggttttatgg caggcacaca aagaaaccct
2401  cagatggctc agtatggacc tcaacagaca ggaccatcca tgtcgcctca tccttctcct
2461  gggggccaga tgcatgctgg aatcagtagc tttcagcaga gtaactcaag tgggacttac
2521  ggtccacaga tgagccagta tggaccacaa ggtaactact ccagaccccc agcgtatagt
2581  ggggtgccca gtgcaagcta gcggccca gggcccggta tgggtatcag tgccaacaac
2641  cagatgcatg gacaagggcc aagccagcca tgtggtgctg tgcccctggg acgaatgcca
2701  tcagctggga tgcagaacag accatttcct ggaaatatga gcagcatgac ccccagttct
2761  cctggcatgt ctcagcaggg agggccagga tggggccgc caatgccaac tgtgaaccgt
2821  aaggcacagg aggcagccgc agcagtgatg caggctgctg cgaactcagc acaaagcagg
2881  caaggcagtt tccccggcat gaaccagagt ggacttatgg cttccagctc tccctacagc
2941  cagcccatga acaacagctc tagcctgatg aacacgcagg cgccgcccta cagcatggcg
3001  cccgccatgg tgaacagctc ggcagcatct gtgggtcttg cagatatgat gtctcctggt
3061  gaatccaaac tgccctgcc tctcaaagca gacggcaaag aagaaggcac tccacagccc
3121  gagagcaagt caaagaagtc cagctcctcc accactactg gggagaagat cacgaaggtg
3181  tacgagctgg ggaatgagcc agagagaaag ctctgggtcg accgatacct caccttcatg
3241  gaagagagag gctctcctgt ctcaagtctg cctgccgtgg gcaagaagcc cctggacctg
3301  ttccgactct acgtctgcgt caaagagatc gggggttggg cccaggttaa taaaaacaag
3361  aagtggcgtg agctggcaac caacctaaac gttggcacct caagcagtgc agcgagctcc
3421  ctgaaaaagc agtatattca gtacctgttt gcctttgagt gcaagatcga acgtggggag
3481  gagccccgc cggaagtctt cagcaccggg acaccaaaa agcagcccaa gctccagccg
3541  ccatctcctg ctaactcggg atccttgcaa ggcccacaga cccccagtc aactggcagc
3601  aattccatgg cagaggttcc aggtgacctg aagccaccta ccccagcctc caccctcac
3661  ggccagatga ctccaatgca aggtggaaga agcagtacaa tcagtgtgca cgacccattc
3721  tcagatgtga gtgattcatc cttcccgaaa cggaactcca tgactccaaa cgcccctac
3781  cagcagggca tgagcatgcc cgatgtgatg gcaggatgc cctatgagcc aacaaggac
3841  cccttggg gaatgagaaa agtgcctgga agcagcgagc cttatgac gcaaggacag
3901  atgcccaaca gcagcatgca ggacatgtac aaccaaagtc cctccggagc aatgtctaac
3961  ctgggcatgg gcagcgcca gcagtttccc tatggagcca gttacgaccg aaggcatgaa
4021  ccttatgggc agcagtatcc aggccaaggc cctccctcgg acagccgcc gtatggaggg
4081  caccagcccg gcctgtaccc acagcagccg aattacaaac gccatatgga cggcatgtac
4141  gggcccccag ccaagcgcca cgagggcgac atgtacaaca tgcagtacag cagccagcag
4201  caggagatgt acaaccagta tggaggctcc tactcgggcc cggaccgcag gcccatccag
4261  ggccagtacc cgtatcccta cagcagggag aggatgcagg gccgggca gatccagaca
4321  cacggaatcc cgcctcagat gatgggcggc ccgctgcagt cgtcctccag tgaggggcct
4381  cagcagaata tgtgggcagc acgcaatgat atgccttatc cctaccagaa caggcagggc
4441  cctggcggcc ctacacaggc gccccttac ccaggcatga accgcacaga cgatatgatg
4501  gtacccgatc agaggataaa tcatgagagc cagtggcctt ctcacgtcag ccagcgtcag
4561  cctttatatg cgtcctcagc ctccatgcag cccatcacac gcccaccaca gccgtcctac
```

TABLE 1-continued

```
4621  cagacgccac cgtcactgcc aaatcacatc tccagggcgc ccagcccagc gtccttccag
4681  cgctccctgg agaaccgcat gtctccaagc aagtctcctt ttctgccgtc tatgaagatg
4741  cagaaggtca tgcccacggt ccccacatcc caggtcaccg ggccaccacc ccaaccaccc
4801  ccaatcagaa gggagatcac ctttcctcct ggctcagtag aagcatcaca accagtcttg
4861  aaacaaaggc gaaagattac ctccaaagat atcgttactc ctgaggcgtg gcgtgtgatg
4921  atgtcccttta aatcaggtct tttggctgag agtacgtggg cttttggacac tattaatatt
4981  cttctgtatg atgacagcac tgttgctact ttcaatctct cccagttgtc tggatttctc
5041  gaactttttag tcgagtactt tagaaaatgc ctgattgaca ttttttggaat tcttatggaa
5101  tatgaagtgg gagaccccag ccaaaaagca cttgatcaca acgcagcaag gaaggatgac
5161  agccagtcct tggcagacga ttctgggaaa gaggaggaag atgctgaatg tattgatgac
5221  gacgaggaag acgaggagga tgaggaggaa gacagcgaga agacagaaag cgatgaaaag
5281  agcagcatcg ctctgactgc cccggacgcc gctgcagacc caaaggagaa gcccaagcaa
5341  gccagtaagt tcgacaagct gccaataaag atagtcaaaa agaacaacct gtttgttgtt
5401  gaccgatctg acaagttggg gcgtgtgcag gagttcaata gtggccttct gcactggcag
5461  ctcggcgggg gtgacaccac cgagcacatt cagactcact ttgagagcaa gatggaaatt
5521  cctcctcgca ggcgcccacc tcccccctta agctccgcag gtagaaagaa agagcaagaa
5581  ggcaaaggcg actctgaaga gcagcaagag aaaagcatca tagcaaccat cgatgacgtc
5641  ctctctgctc ggccaggggc attgcctgaa gacgcaaacc ctgggcccca gaccgaaagc
5701  agtaagtttc cctttggtat ccagcaagcc aaaagtcacc ggaacatcaa gctgctggag
5761  gacgagccca ggagccgaga cgagactcct ctgtgtacca tcgcgcactg gcaggactcg
5821  ctggctaagc gatgcatctg tgtgtccaat attgtccgta gcttgtcatt cgtgcctggc
5881  aatgatgccg aaatgtccaa acatccaggc ctggtgctga tcctggggaa gctgattctt
5941  cttcaccacg agcatccaga gagaaagcga gcaccgcaga cctatgagaa agaggaggat
6001  gaggacaagg gggtggcctg cagcaaagat gagtggtggt gggactgcct cgaggtcttg
6061  agggataaca cgttggtcac gttggccaac atttccgggc agctagactt gtctgcttac
6121  acggaaagca tctgcttgcc aattttggat ggcttgctgc actggatggt gtgcccgtct
6181  gcagaggcac aagatccctt tccaactgtg ggacccaact cggtcctgtc gcctcagaga
6241  cttgtgctgg agaccctctg taaactcagt atccaggaca ataatgtgga cctgatcttg
6301  gccactcctc catttagtcg tcaggagaaa ttctatgcta cattagttag gtacgttggg
6361  gatcgcaaaa acccagtctg tcgagaaatg tccatggcgc ttttatcgaa ccttgcccaa
6421  ggggacgcac tagcagcaag ggccatagct gtgcagaaag gaagcattgg aaacttgata
6481  agcttcctag aggatggggt cacgatggcc cagtaccagc agagccagca caacctcatg
6541  cacatgcagc ccccgcccct ggaaccacct agcgtagaca tgatgtgcag ggcggccaag
6601  gctttgctag ccatggccag agtggacgaa aaccgctcgg aattcctttt gcacgagggc
6661  cggttgctgg atatctcgat atcagctgtc ctgaactctc tggttgcatc tgtcatctgt
6721  gatgtactgt ttcagattgg gcagttatga cataagtgag aaggcaagca tgtgtgagtg
6781  aagattagag ggtcacatat aactggctgt tttctgttct tgtttatcca gcgtaggaag
6841  aaggaaaaga aaatctttgc tcctctgccc cattcactat ttaccaattg ggaattaaag
6901  aaataattaa tttgaacagt tatgaaatta atatttgctg tctgtgtgta taagtacatc
6961  ctttggggtt ttttttttct cttttttttta accaaagttg ctgtctagtg cattcaaagg
```

TABLE 1-continued

```
7021  tcactttttg ttcttcacag atctttttaa tgttctttcc catgttgtat tgcattttg
7081  ggggaagcaa attgacttta aagaaaaaag ttgtggcaaa agatgctaag atgcgaaaat
7141  ttcaccacac tgagtcaaaa aggtgaaaaa ttatccattt cctatgcgtt ttactcctca
7201  gagaatgaaa aaaactgcat cccatcaccc aaagttctgt gcaatagaaa tttctacaga
7261  tacaggtata ggggctcaag gaggtatgtc ggtcagtagt caaaactatg aaatgatact
7321  ggtttctcca caggaatatg gttccattag gctgggagca aaaacaatgt ttttaagat
7381  tgagaataca tacctgacaa cgatccggaa actgctcctc accactcccg tcatgcctgc
7441  tgtcggcgtt tgaccttcca cgtgacagtt cttcacaatt cctttcatca ttttttaaat
7501  attttttta ctgcctatgg gctgtgatgt atatagaagt tgtacattaa acatccctc
7561  attttttct tttcttttt ttttttttt ttagtacaaa gttttagttt cttttcatg
7621  atgtggtaac tacgaagtga tggtagattt aataatttt ttatttttat tttatatatt
7681  ttttcattag ggccatatct ccaaaaaaag aaagaaaaaa tacaaaaaac aaaaacaaaa
7741  aaaaaagagg gtaatgtaca agtttctgta tgtataaagt catgctcgat ttcaggagag
7801  cagctgatca caatttgctt catgaatcaa ggtgtggaaa tggttatata tggattgatt
7861  tagaaaatgg ttaccagtac agtcaaaaaa gagaaaatga aaaaaataca actaaaagga
7921  agaaacacaa cttcaaagat ttttcagtga tgagaatcca catttgtatt tcaagataat
7981  gtagtttaaa aaaaaaaaa agaaaaaaac ttgatgtaaa ttcctccttt tcctctggct
8041  taatgaatat catttattca gtataaaatc tttatatgtt ccacatgtta agaataaatg
8101  tacattaaat cttgttaagc actgtgatgg gtgttcttga atactgttct agtttcctta
8161  aagtggtttc ctagtaatca agttatttac aagaaatagg ggaatgcagc agtgtattca
8221  cattataaaa ccctacattt ggaagagacc tttagggggtt acctacttta gagtggggag
8281  caacagtttg attttctcaa attacttagc taattagtct ttctttgaag caattaactc
8341  taacgacatt gaggtatgat cattttcagt atttatggga ggtggctgct gacccacttg
8401  aggtgagatc tcagaagctt aactggcctg aaaatgtaac attctgcctt ttactaactc
8461  catcttagtt taatcaaagt tcaatctatt ccttgtttct tctgtgtgcc tcagagttat
8521  tttgcattta gtttactcca ccgtgtataa tatttatact gtgcaatgtt aaaaaagaat
8581  ctgttatatt gtatgtggtg tacatagtgc aaagtgatga tttctatttc agggcatatt
8641  atggttctca tattccttcc tacctggtgc acagtagctt tttaatacta gtcacttcta
8701  atttaaactt tctcttcctg ggtcattgac tgttactgtg taataatcga tttctttgaa
8761  actgctgcat aattatgctg ttagtggacc tctacctctt ctcttccctc tcccaatcac
8821  agtatactca gaatcccag ccctcgcat acattgtgtc ggttcacatt actcacagta
8881  atatatggaa gagttagaca agaacatgca gttacagtca ttgtgagacg tgactctcca
8941  gtgtcacgag gaaaaaaatc atcttttctg caaacagtct ctcatctgtc aactcccaca
9001  ttactgagtc aaacagtctt cttacataac aatgcaacca aatatatgtt gaattaaaga
9061  cccatttata attctgcttt aaatacatct gcttgctaag aacagatttc agtgctccaa
9121  gcttcaaata tggagatttg taagagggaa ttcaatatta ttctaatttc tctcttacag
9181  agtacaaata aaaggtgtat acaaactccg aacatatcca gtattccaat tcctttgtca
9241  atcagaagag taaataatt aacaaaagac tgttgttatg gtttgcattg taaccgatac
9301  gcagagtctg accgttgggc aacaagtttt tctatcctga tgcgcaacac agtctctaga
9361  gactaatcca ggaagacttt agcctccttt ccatattctc accccgaat caagatttac
```

TABLE 1-continued

```
9421  agaagcccac gaagaattta cagcctgctt gagatcatct tgcctataaa ctgagttatt
9481  gctttgtcct aaaaattagt cggtttttt ttttctatga ggcttttcag aaatttacag
9541  gatgcccaga ctttacatgt gtaccaaaaa aaaaaaaaag ataaaaaata aaggtgcaaa
9601  gaaagtttag tattttggaa tggtgctata aagttgaaaa aaaaaaa
```

SEQ ID NO: 38 Human ARID1B Amino Acid Sequence isoform B (NP_065783.3)

```
   1  mahnagaaaa agthsaksgg seaalkeggs aaalsssss saaaaaasss sssgpgsame
  61  tgllpnhklk tvgeapaapp hqqhhhhha hhhhhahhl hhhhalqqql nqfqqqqqqq
 121  qqqqqqqqq qhpisnnnsl ggagggapqp gpdmeqpqhg gakdsaaggq adppgpplls
 181  kpgdeddapp kmgepaggry ehpglgalgt qqppvavpgg gggpaavpef nnyygsaapa
 241  sggpggragp cfdqhggqqs pgmgmmhsas aaaagapgsm dplqnshegy pnsqcnhypg
 301  ysrpgaggg ggggggggs ggggggggag aggagagava aaaaaaaaa gggggggygg
 361  ssagygvlss prqqgggmmm gpggggaasl skaaagsaag gfqrfaggnq hpsgatptln
 421  qlltspspmm rsyggsypey sspsappppp sqpgsgaaaa gaaaggqqaa agmglgkdmg
 481  aqyaaaspaw aaaqqrshpa mspgtpgptm grsqgspmdp mvmkrpglyg mgsnphsqpq
 541  qsspypggsy gppgpqrypi giqgrtpgam agmqypqqqd sgdatwketf wlmppqyggq
 601  gvsgycqqgq qpyysqqpqp phlppgagyl psqsqqryqp qqdmsgegyg trsqpplapg
 661  kpnhedlnli ggerpsslpd lsgsiddlpt gteatlssav sasgststsq dqsnpaqspf
 721  sphasphlss ipggpspspv gspvgsnqsr sgpispasip gsqmppqppg sqsessshpa
 781  lsgspmpger gfmagtqrnp qmagygpqqt gpsmsphpsp ggqmhagiss fqqsnssgty
 841  gpqmsqygpq gnysrppays gvpsasysgp gpgmgisann qmhgqgpsqp cgavplgrmp
 901  sagmqnrpfp gnmssmtpss pgmsqqggpg mgppmptvnr kaqeaaaavm qaaansagsr
 961  qgsfpgmnqs glmasssspys qpmnnssslm ntqappysma pamvnssaas vgladmmspg
1021  esklplplka dgkeegtpqp eskskkssss tttgekitkv yelgneperk lwvdryltfm
1081  eergspvssl pavgkkpldl frlyvcvkei gglaqvnknk kwrelatnln vgtsssaass
1141  lkkgyigylf afeckierge epppevfstg dtkkuklqp pspansgslq gpqtpcistgs
1201  nsmaevpgdl kpptpastph gqmtpmqggr sstisvhdpf sdvsdssfpk rnsmtpnapy
1261  qqgmsmpdvm grmpyepnkd pfggmrkvpg ssepfmtqgq mpnssmqdmy nqspsgamsn
1321  lgmgqrqqfp ygasydrrhe pygqqypgqg ppsgqppygg hqpglypqqp nykrhmdgmy
1381  gppakrhegd mynmgyssqg qemynqyggs ysgpdrrpiq gqypypysre rmqgpgqiqt
1441  hgippqmmgg plqssssegp qqnmwaarnd mpypyqnrqg pggptqappy pgmnrtddmm
1501  vpdqrinhes qwpshvsqrq pymsssasmq pitrppgpsy qtppslpnhi srapspasfq
1561  rslenrmsps kspflpsmkm qkvmptvpts qvtgpppqpp pirreitfpp gsveasqpvl
1621  kqrrkitskd ivtpeawrvm mslksgllae stwaldtini llyddstvat fnlsqlsgfl
1681  ellveyfrkc lidifgilme yevgdpsqka ldhnaarkdd sqsladdsgk eeedaecidd
1741  deedeedeee dsektesdek ssialtapda aadpkekpkq askfdklpik ivkknnlfvv
1801  drsdklgrvq efnsgllhwq lgggdttehi qthfeskmei pprrrppppl ssagrkkeqe
1861  gkgdseeqqe ksiiatiddv lsarpgalpe danpgpqtes skfpfgiqqa kshrniklle
1921  deprsrdetp lctiahwqds lakrcicvsn ivrslsfvpg ndaemskhpg lvlilgklil
1981  lhhehperkr apqtyekeed edkgvacskd ewwwdclevl rdntivtlan isgqldlsay
2041  tesiclpild gllhwmvcps aeaqdpfptv gpnsvlspqr lvleticklls iqdnnvdlil
2101  atppfsrqek fyativryvg drknpvcrem smallsnlaq gdalaaraia vqkgsignli
```

TABLE 1-continued

```
2161 sfledgvtma qyqqsqhnlm hmqppplepp svdmmcraak allamarvde nrsefllheg 2221 rlldisisav lnslvasvic dvlfgigql
```

SEQ ID NO: 39 Human ARID1B cDNA Sequence Variant 3 (NM_001346813.1, CDS: from 76 to 6945)

```
   1 ggggcggcg gcgacggcgg cggcggcctg aacagtgtgc accaccaccc cctgctcccc 61 cgtcacgaac tcaacatggc ccataacgcg ggcgccgcgg ccgccgccgg cacccacagc 121 gccaagagcg gcggctccga ggcggctctc aaggagggtg gaagcgccgc gcgctgtcc 181 tcctcctcct cctcctccgc ggcggcagcg gcggcatcct cttcctcctc gtcgggcccg 241 ggctcggcca tggagacggg gctgctcccc aaccacaaac tgaaaaccgt tggcgaagcc 301 cccgccgcgc cgccccacca gcagcaccac caccaccacc atgcccacca ccaccaccac 361 catgcccacc acctccacca ccaccacgca ctacagcagc agctaaacca gttccagcag 421 cagcagcagc agcagcaaca gcagcagcag cagcagcagc aacagcaaca tcccatttcc 481 aacaacaaca gcttgggcgg cgcgggcggc ggcgcgcctc agcccggccc cgacatggag 541 cagccgcaac atggaggcgc caaggacagt gctgcgggcg ccaggccga ccccccgggc 601 ccgccgctgc tgagcaagcc gggcgacgag gacgacgcgc cgcccaagat gggggagccg 661 gcgggcggcc gctacgagca cccgggcttg ggcgccctgg gcacgcagca gccgccggtc 721 gccgtgcccg ggggcggcgg cggcccggcg gccgtcccgg agtttaataa ttactatggc 781 agcgctgccc ctgcgagcgg cggccccggc ggccgcgctg ggccttgctt tgatcaacat 841 ggcggacaac aaagccccgg gatggggatg atgcactccg cctccgccgc cgccgccggg 901 gcccccggca gcatggaccc cctgcagaac tcccacgaag ggtaccccaa cagccagtgc 961 aaccattatc cgggctacag ccggcccggc gcgggcggcg gcggcggcg cggcggcgga 1021 ggaggaggag gcagcggagg aggaggagga ggaggaggag caggagcagg aggagcagga 1081 gcgggagctg tggcggcggc ggccgcggcg gcggcggcag cagcaggagg cggcggcggc 1141 ggcggctatg ggggctcgtc cgcggggtac ggggtgctga gctcccccg gcagcagggc 1201 ggcggcatga tgatgggccc cggggcggc ggggccgcga gcctcagcaa ggcggccgcc 1261 ggctcggcgg cgggggcctt ccagcgcttc gccggccaga accagcaccc gtcgggggcc 1321 accccgaccc tcaatcagct gctcacctcg cccagcccca tgatgcggag ctacggcggc 1381 agctacccg agtacagcag ccccagcgcg ccgccgccgc cgccgtcgca gccccagtcc 1441 caggcggcgg cggcggggc ggcggcgggc ggccagcagg cggccgcggg catgggcttg 1501 ggcaaggaca tgggcgccca gtacgccgct gccagcccgg cctgggcggc gcgcaacaa 1561 aggagtcacc cggcgatgag ccccggcacc cccggaccga ccatgggcag atcccagggc 1621 agcccaatgg atccaatggt gatgaagaga cctcagttgt atggcatggg cagtaaccct 1681 cattctcagc ctcagcagag cagtccgtac ccaggaggtt cctatggccc tccaggccca 1741 cagcggtatc caattggcat ccagggtcgg actcccgggg ccatggccgg aatgcagtac 1801 cctcagcagc agatgccacc tcagtatgga cagcaaggtg tgagtggtta ctgccagcag 1861 ggccaacagc catattacag ccagcagccg cagcccccgc acctcccacc caggcgcag 1921 tatctgccgt cccagtccca gcagaggtac cagccgcagc aggacatgtc tcaggaaggc 1981 tatggaacta gatctcaacc tcctctggcc cccggaaaac taaccatga agacttgaac 2041 ttaatacagc aagaaagacc atcaagttta ccagatctgt ctggctccat tgatgacctc 2101 cccacgggaa cggaagcaac tttgagctca gcagtcagtg catccgggtc cacgagcagc 2161 caagggggatc agagcaaccc ggcgcagtcg cctttctccc cacatgcgtc ccctcatctc
```

TABLE 1-continued

```
2221  tccagcatcc cgggggggccc atctccctct cctgttggct ctcctgtagg aagcaaccag
2281  tctcgatctg gcccaatctc tcctgcaagt atcccaggta gtcagatgcc tccgcagcca
2341  cccgggagcc agtcagaatc cagttcccat cccgccttga gccagtcacc aatgccacag
2401  gaaagaggtt ttatggcagg cacacaaaga aaccctcaga tggctcagta tggacctcaa
2461  cagacaggac catccatgtc gcctcatcct tctcctgggg gccagatgca tgctggaatc
2521  agtagctttc agcagagtaa ctcaagtggg acttacggtc cacagatgag ccagtatgga
2581  ccacaaggta actactccag acccccagcg tatagtgggg tgcccagtgc aagctacagc
2641  ggcccagggc ccggtatggg tatcagtgcc aacaaccaga tgcatggaca agggccaagc
2701  cagccatgtg gtgctgtgcc cctgggacga atgccatcag ctgggatgca gaacagacca
2761  tttcctggaa atatgagcag catgaccccc agttcctgg gcatgtctca gcagggaggg
2821  ccaggaatgg ggccgccaat gccaactgtg aaccgtaagg cacaggaggc agccgcagca
2881  gtgatgcagg ctgctgcgaa ctcagcacaa gcaggcaag gcagtttccc cggcatgaac
2941  cagagtggac ttatggcttc cagctctccc tacagccagc ccatgaacaa cagctctagc
3001  ctgatgaaca cgcaggcgcc gccctacagc atggcgcccg ccatggtgaa cagctcggca
3061  gcatctgtgg gtcttgcaga tatgatgtct cctggtgaat ccaaactgcc cctgcctctc
3121  aaagcagacg gcaaagaaga aggcactcca cagcccgaga gcaagtcaaa ggatagctac
3181  agctctcagg gtatttctca gcccccaacc ccaggcaacc tgccagtccc ttccccaatg
3241  tcccccagct ctgctagcat ctcctcattt catggagatg aaagtgatag cattagcagc
3301  ccaggctggc aaagactcc atcaagccct aagtccagct cctccaccac tactggggag
3361  aagatcacga aggtgtacga gctggggaat gagccagaga gaaagctctg ggtcgaccga
3421  tacctcacct tcatggaaga gagaggctct cctgtctcaa gtctgcctgc cgtgggcaag
3481  aagcccctgg acctgttccg actctacgtc tgcgtcaaag atcggggg tttggcccag
3541  gttaataaaa acaagaagtg gcgtgagctg gcaaccaacc taaacgttgg cacctcaagc
3601  agtgcagcga gctccctgaa aaagcagtat attcagtacc tgtttgcctt tgagtgcaag
3661  atcgaacgtg gggaggagcc cccgccggaa gtcttcagca ccggggacac caaaaagcag
3721  cccaagctcc agccgccatc tcctgctaac tcgggatcct tgcaaggccc acagaccccc
3781  cagtcaactg gcagcaattc catggcagag gttccaggtg acctgaagcc acctaccccca
3841  gcctccaccc ctcacggcca gatgactcca atgcaaggtg gaagaagcag tacaatcagt
3901  gtgcacgacc cattctcaga tgtgagtgat tcatccttcc cgaaacgaa ctccatgact
3961  ccaaacgccc cctaccagca gggcatgagc atgcccgatg tgatgggcag gatgccctat
4021  gagcccaaca aggacccctt tggggaatg agaaaagtgc ctggaagcag cgagccctttt
4081  atgacgcaag gacagatgcc caacagcagc atgcaggaca tgtacaacca aagtccctcc
4141  ggagcaatgt ctaacctggg catggggcag cgccagcagt ttccctatgg agccagttac
4201  gaccgaaggc atgaacctta tgggcagcag tatccaggcc aaggccctcc ctcgggacag
4261  ccgccgtatg agggcacca gccggcctg tacccacagc agccgaatta caaacgccat
4321  atggacggca tgtacggcc cccagccaag cgccacgagg cgacatgta caacatgcag
4381  tacagcagcc agcagcagga gatgtacaac cagtatggag ctcctactc gggcccggac
4441  cgcaggccca tccagggcca gtaccgtat ccctacagca gggagaggat gcagggcccg
4501  gggcagatcc agacacacgg aatcccgcct cagatgatgg gcggcccgct gcagtcgtcc
4561  tccagtgagg ggcctcagca gaatatgtgg gcagcacgca atgatatgcc ttatccctac
```

TABLE 1-continued

```
4621  cagaacaggc agggccctgg cggccctaca caggcgcccc cttacccagg catgaaccgc
4681  acagacgata tgatggtacc cgatcagagg ataaatcatg agagccagtg gccttctcac
4741  gtcagccagc gtcagcctta tatgtcgtcc tcagcctcca tgcagcccat cacacgccca
4801  ccacagccgt cctaccagac gccaccgtca ctgccaaatc acatctccag ggcgcccagc
4861  ccagcgtcct tccagcgctc cctggagaac cgcatgtctc caagcaagtc tccttttctg
4921  ccgtctatga agatgcagaa ggtcatgccc acggtcccca catcccaggt caccggggca
4981  ccaccccaac cacccccaat cagaagggag atcacctttc ctcctggctc agtagaagca
5041  tcacaaccag tcttgaaaca aaggcgaaag attacctcca aagatatcgt tactcctgag
5101  gcgtggcgtg tgatgatgtc ccttaaatca ggtcttttgg ctgagagtac gtgggctttg
5161  gacactatta atattcttct gtatgatgac agcactgttg ctactttcaa tctctcccag
5221  ttgtctggat ttctcgaact tttagtcgag tactttagaa aatgcctgat tgacattttt
5281  ggaattctta tggaatatga agtgggagac cccagccaaa aagcacttga tcacaacgca
5341  gcaaggaagg atgacagcca gtccttggca gacgattctg ggaaagagga ggaagatgct
5401  gaatgtattg atgacgacga ggaagacgag gaggatgagg aggaagacag cgagaagaca
5461  gaaagcgatg aaaagagcag catcgctctg actgccccgg acgccgctgc agacccaaag
5521  gagaagccca gcaagccag taagttcgac aagctgccaa taaagatagt caaaaagaac
5581  aacctgtttg ttgttgaccg atctgacaag ttggggcgtg tgcaggagtt caatagtggc
5641  cttctgcact ggcagctcgg cggggtgac accaccgagc acattcagac tcactttgag
5701  agcaagatgg aaattcctcc tcgcaggcgc ccacctcccc ccttaagctc cgcaggtaga
5761  aagaaagagc aagaaggcaa aggcgactct gaagagcagc aagagaaaag catcatagca
5821  accatcgatg acgtcctctc tgctcggcca ggggcattgc ctgaagacgc aaaccctggg
5881  ccccagaccg aaagcagtaa gtttcccttt ggtatccagc aagccaaaag tcaccggaac
5941  atcaagctgc tggaggacga gcccaggagc cgagacgaga ctcctctgtg taccatcgcg
6001  cactggcagg actcgctggc taagcgatgc atctgtgtgt ccaatattgt ccgtagcttg
6061  tcattcgtgc ctggcaatga tgccgaaatg tccaaacatc caggcctggt gctgatcctg
6121  gggaagctga ttcttcttca ccacgagcat ccagagagaa agcgagcacc gcagacctat
6181  gagaaagagg aggatgagga caaggggtg gcctgcagca agatgagtg gtggtgggac
6241  tgcctcgagg tcttgaggga taacacgttg gtcacgttgg ccaacatttc cgggcagcta
6301  gacttgtctg cttacacgga aagcatctgc ttgccaattt tggatggctt gctgcactgg
6361  atggtgtgcc cgtctgcaga ggcacaagat cccttttccaa ctgtgggacc caactcggtc
6421  ctgtcgcctc agagacttgt gctggagacc ctctgtaaac tcagtatcca ggacaataat
6481  gtggacctga tcttggccac tcctccattt agtcgtcagg agaaattcta tgctacatta
6541  gttaggtacg ttggggatcg caaaaaccca gtctgtcgag aaatgtccat ggcgctttta
6601  tcgaaccttg cccaagggga cgcactagca gcaagggcca tagctgtgca gaaaggaagc
6661  attggaaact tgataagctt cctagaggat ggggtcacga tggcccagta ccagcagagc
6721  cagcacaacc tcatgcacat gcagcccccg ccctggaac cacctagcgt agacatgatg
6781  tgcagggcgg ccaaggcttt gctagccatg gccagagtgg acgaaaaccg ctcggaattc
6841  cttttgcacg agggccggtt gctggatatc tcgatatcag ctgtcctgaa ctctctggtt
6901  gcatctgtca tctgtgatgt actgtttcag attgggcagt tatgacataa gtgagaaggc
6961  aagcatgtgt gagtgaagat tagagggtca catataactg gctgttttct gttcttgttt
```

TABLE 1-continued

```
7021  atccagcgta ggaagaagga aaagaaaatc tttgctcctc tgccccattc actatttacc
7081  aattgggaat taaagaaata attaatttga acagttatga aattaatatt tgctgtctgt
7141  gtgtataagt acatcctttg gggttttttt tttctctttt ttttaaccaa agttgctgtc
7201  tagtgcattc aaaggtcact ttttgttctt cacagatctt tttaatgttc tttcccatgt
7261  tgtattgcat ttttggggga agcaaattga ctttaaagaa aaaagttgtg gcaaaagatg
7321  ctaagatgcg aaaatttcac cacactgagt caaaaaggtg aaaaattatc catttcctat
7381  gcgttttact cctcagagaa tgaaaaaaac tgcatcccat cacccaaagt tctgtgcaat
7441  agaaatttct acagatacag gtataggggc tcaaggaggt atgtcggtca gtagtcaaaa
7501  ctatgaaatg atactggttt ctccacagga atatggttcc attaggctgg gagcaaaaac
7561  aatgttttt aagattgaga atacatacct gacaacgatc cggaaactgc tcctcaccac
7621  tcccgtcatg cctgctgtcg gcgtttgacc ttccacgtga cagttcttca caattccttt
7681  catcattttt taaatatttt ttttactgcc tatgggctgt gatgtatata gaagttgtac
7741  attaaacata ccctcatttt tttcttttct tttttttttt tttttttagt acaaagtttt
7801  agtttctttt tcatgatgtg gtaactacga agtgatggta gatttaaata attttttatt
7861  tttattttat atattttttc attagggcca tatctccaaa aaaagaaaga aaaaatacaa
7921  aaaacaaaaa caaaaaaaaa agagggtaat gtacaagttt ctgtatgtat aaagtcatgc
7981  tcgatttcag gagagcagct gatcacaatt tgcttcatga atcaaggtgt ggaaatggtt
8041  atatatggat tgatttagaa aatggttacc agtacagtca aaaagagaa aatgaaaaaa
8101  atacaactaa aaggaagaaa cacaacttca aagatttttc agtgatgaga atccacattt
8161  gtatttcaag ataatgtagt ttaaaaaaaa aaaaagaaa aaaacttgat gtaaattcct
8221  ccttttcctc tggcttaatg aatatcattt attcagtata aaatctttat atgttccaca
8281  tgttaagaat aaatgtacat taaatcttgt taagcactgt gatgggtgtt cttgaatact
8341  gttctagttt ccttaaagtg gtttcctagt aatcaagtta tttacaagaa ataggggaat
8401  gcagcagtgt attcacatta taaaaccta catttggaag agacctttag gggttaccta
8461  ctttagagtg gggagcaaca gtttgatttt ctcaaattac ttagctaatt agtctttctt
8521  tgaagcaatt aactctaacg acattgaggt atgatcattt tcagtattta tgggaggtgg
8581  ctgctgaccc acttgagtg agatctcaga agcttaactg gcctgaaaat gtaacattct
8641  gccttttact aactccatct tagtttaatc aaagttcaat ctattccttg tttcttctgt
8701  gtgcctcaga gttatttgc atttagtta ctccaccgtg tataatattt atactgtgca
8761  atgttaaaaa agaatctgtt atattgtatg tggtgtacat agtgcaaagt gatgatttct
8821  atttcagggc atattatggt tctcatattc cttcctacct ggtgcacagt agctttttaa
8881  tactagtcac ttctaattta aactttctct tcctgggtca ttgactgtta ctgtgtaata
8941  atcgatttct ttgaaactgc tgcataatta tgctgttagt ggacctctac ctcttctctt
9001  ccctctccca atcacagtat actcagaatc cccagcccct cgcatacatt gtgtcggttc
9061  acattactca cagtaatata tggaagagtt agacaagaac atgcagttac agtcattgtg
9121  agacgtgact ctccagtgtc acgaggaaaa aaatcatctt ttctgcaaac agtctctcat
9181  ctgtcaactc ccacattact gagtcaaaca gtcttcttac ataacaatgc aaccaaatat
9241  atgttgaatt aaagacccat ttataattct gctttaaata catctgcttg ctaagaacag
9301  atttcagtgc tccaagcttc aaatatggag atttgtaaga gggaattcaa tattattcta
9361  atttctctct tacagagtac aaataaaagg tgtatacaaa ctccgaacat atccagtatt
```

TABLE 1-continued

```
9421  ccaattcctt tgtcaatcag aagagtaaaa taattaacaa aagactgttg ttatggtttg
9481  cattgtaacc gatacgcaga gtctgaccgt tgggcaacaa gttttttctat cctgatgcgc
9541  aacacagtct ctagagacta atccaggaag actttagcct cctttccata ttctcacccc
9601  cgaatcaaga tttacagaag cccacgaaga atttcagcc tgcttgagat catcttgcct
9661  ataaactgag ttattgcttt gtcctaaaaa ttagtcggtt ttttttttc tatgaggctt
9721  ttcagaaatt tacaggatgc ccagacttta catgtgtacc aaaaaaaaaa aaaagataaa
9781  aaataaaggt gcaaagaaag tttagtattt tggaatggtg ctataaagtt gaa
```

SEQ ID NO: 40 Human ARID1B Amino Acid Sequence isoform C
(NP_001333742.1)

```
   1  mahnagaaaa agthsaksgg seaalkeggs aaalsssss saaaaaasss sssgpgsame
  61  tgllpnhklk tvgeapaapp hqqhhhhha hhhhhahhl hhhhalggql ngfqqqqqgg
 121  ggqqqqqqqg ghpisnnnsl ggagggapqp gpdmegpqhg gakdsaaggq adppgpplls
 181  kpgdeddapp kmgepaggry ehpglgalgt ggppvavpgg gggpaavpef nnyygsaapa
 241  sggpggragp cfdqhggggs pgmgmmhsas aaaagapgsm dplqnshegy pnsgcnhypg
 301  ysrpgagggg gggggggggs ggggggggag aggagagava aaaaaaaaaa gggggggygg
 361  ssagygvlss prqqgggmmm gpgggggaasl skaaagsaag gfgrfaggng hpsgatptln
 421  qlltspspmm rsyggsypey sspsappppp sgpgsgaaaa gaaaggqqaa agmglgkdmg
 481  aqyaaaspaw aaaggrshpa mspgtpgptm grsqgspmdp mvmkrpglyg mgsnphsgpg
 541  qsspypggsy gppgpqrypi giqgrtpgam agmgypqqqm ppgygggggvs gycqqgqqpy
 601  ysggpqpphl ppgagylpsq sggrygpqqd msgegygtrs qpplapgkpn hedlnligge
 661  rpsslpdlsg siddlptgte atlssaysas gstssggdgs npaqspfsph asphlssipg
 721  gpspspvgsp vgsnqsrsgp ispasipgsq mppgppgsgs essshpalsq spmpqergfm
 781  agtgrnpqma gygpggtgps msphpspggq mhagissfqg snssgtygpq msgygpggny
 841  srppaysgvp sasysgpgpg mgisannqmh gggpsgpcga vplgrmpsag mqnrpfpgnm
 901  ssmtpsspgm sqqggpgmgp pmptvnrkaq eaaaavmqaa ansagsrggs fpgmngsglm
 961  assspysgpm nnssslmntq appysmapam vnssaasvgl admmspgesk lplplkadgk
1021  eegtpqpesk skdsyssqgi sqpptpgnlp vpspmspssa sissfhgdes dsisspgwpk
1081  tpsspkssss tttgekitkv yelgneperk lwvdryltfm eergspvssl pavgkkpldl
1141  frlyvcvkei gglaqvnknk kwrelatnln vgtsssaass lkkgyigylf afeckierge
1201  epppevfstg dtkkgpklgp pspansgslq gpqtpgstgs nsmaevpgdl kpptpastph
1261  ggmtpmgggr sstisvhdpf sdvsdssfpk rnsmtpnapy gggmsmpdvm grmpyepnkd
1321  pfggmrkvpg ssepfmtggq mpnssmgdmy nqspsgamsn lgmggrqqfp ygasydrrhe
1381  pygggypgqg ppsgqppygg hqpglypggp nykrhmdgmy gppakrhegd mynmgyssqg
1441  gemyngyggs ysgpdrrpiq gqypypysre rmggpggigt hgippqmmgg plqssssegp
1501  qqnmwaarnd mpypyqnrqg pggptqappy pgmnrtddmm vpdqrinhes qwpshvsqrq
1561  pymsssasmq pitrppgpsy qtppslpnhi srapspasfq rslenrmsps kspflpsmkm
1621  qkvmptvpts qvtgpppqpp pirreitfpp gsveasqpvl kqrrkitskd ivtpeawrvm
1681  mslksgllae stwaldtini llyddstvat fnlsqlsgfl ellveyfrkc lidifgilme
1741  yevgdpsqka ldhnaarkdd sqsladdsgk eeedaecidd deedeedeee dsektesdek
1801  ssialtapda aadpkekpkq askfdklpik ivkknnlfvv drsdklgrvq efnsgllhwq
1861  lgggdttehi qthfeskmei pprrrppppl ssagrkkeqe gkgdseeqqe ksiiatiddv
```

TABLE 1-continued

```
1921 lsarpgalpe danpgpqtes skfpfgiqqa kshrniklle deprsrdetp lctiahwqds 1981 lakrcicvsn ivrslsfvpg ndaemskhpg lvlilgklil lhhehperkr apqtyekeed 2041 edkgvacskd ewwwdclevl rdntivtlan isgqldlsay tesiclpild gllhwmvcps 2101 aeaqdpfptv gpnsvlspqr lvleticklc iqdnnvdlil atppfsrqek fyativryvg 2161 drknpvcrem smallsnlaq gdalaaraia vqkgsignli sfledgvtma qyqqsqhnlm 2221 hmqppplepp svdmmcraak allamarvde nrsefllheg rlldisisav lnslvasvic 2281 dvlfgigql
```

SEQ ID NO: 41 Mouse ARID1B cDNA Sequence (NM_001085355.1, CDS: from 22 to 6756)

```
   1 tcggcgggcc ccggctcgac catggagacc gggctgctcc ccaaccacaa actgaaagcc 61 gttggcgagg ccccgctgc accgccccat cagcagcacc accaccacca tgcccaccac 121 caccaccacc accatgccca ccacctccac cacctccacc accaccacgc actacagcag 181 cagctaaacc agttccagca gccgcagccg ccgcagccac agcagcagca gccgccgcca 241 ccgccgcagc agcagcatcc cactgccaac aacagcctgg gcggtgcggg cggcggcgcg 301 cctcagcccg gcccggacat ggagcagccg caacatggag gcgccaagga cagtgtcgcg 361 ggcaatcagg ctgacccgca gggccagcct ctgctgagca aaccgggcga cgaggacgac 421 gcgccgccca agatgggggga gccggcgggc agccgctatg agcacccggg cctgggcgcg 481 cagcagcagc ccgcgccggt cgccgtgccc gggggcggcg gcggcccagc ggccgtctcg 541 gagtttaata attactatgg cagcgctgcc cctgctagcg gcggcccgg cggccgcgct 601 gggccttgct ttgatcaaca tggcggacaa caaagccccg ggatggggat gatgcactcc 661 gcctctgccg ccgccggggc ccccagcagc atggaccccc tgcagaactc ccacgaaggg 721 taccccaaca gccagtacaa ccattatccg ggctacagcc ggcccggcgc gggcggcggc 781 ggcggcggcg gcggaggagg aggaggcagc ggaggaggtg gaggaggagg aggagcagga 841 ggagcaggag gagcagcggc agcggcagca ggagccggag ctgtggcggc ggcggccgcg 901 gcggcggcgg cagcagcagc agcagcagga ggaggcggtg gcggcggcta tgggagctcg 961 tcctcggggt acgggtgct gagctccccg cggcagcagg gcggcggcat gatgatgggc 1021 cccggggggcg gcggggccgc gagcctcagc aaggcggccg ccggcgcggc ggcggcggcg 1081 gggggcttcc agcgcttcgc cggccagaac cagcacccgt cggggggctac accgaccctc 1141 aaccagctgc tcacctcacc cagccccatg atgaggagct acggcggtag ctaccccgac 1201 tacagcagct ccagcgcgcc gccgccgccc tcgcagcccc agtcccaggc ggcggcgggg 1261 gcggcggcgg gtggccagca ggcggccgcg ggcatgggct gggcaagga cctaggcgcc 1321 cagtacgccg ctgccagccc ggcctgggcg ccgcgcaac aaaggagtca cccggcgatg 1381 agccccggca ccccggacc gaccatgggc agatcccagg cagcccgat ggacccaatg 1441 gtgatgaaga gacctcagtt gtatgggatg gtactcacc cccactccca gccacagcag 1501 agcagcccat acccaggagg ctcctacggt ccccaggtg cacagcggta tccccttggc 1561 atgcagggcc gggctccagg ggccctggga ggcttgcagt acccgcagca gcagatgcca 1621 ccgcagtacg gacagcaagc tgtgagtggc tactgccagc aaggccagca gccatactac 1681 aaccagcagc cgcagccctc gcacctcccg cccaggcac agtacctgca gccggcggcg 1741 gcgcagtccc agcagaggta ccagccacag caggacatgt ctcaagaagg ctatggaact 1801 agatctcagc ctcctctggc ccctggaaaa tccaaccatg aagacttgaa tttaattcaa 1861 caggaaagac catcgagtct accagacctg tctggctcca tcgatgacct ccccacggga
```

TABLE 1-continued

| | | | | |
|---|---|---|---|---|
| 1921 | acagaagcaa | ctctgagctc | agcagtcagt | gcatccgggt | ctacaagcag | ccagggagat |
| 1981 | cagagcaacc | cagcgcagtc | tcctttctcc | ccacatgcat | cacctcacct | ctccagcatc |
| 2041 | cctggagggc | cgtcaccttc | tcctgttggc | tctcctgtgg | gaagcaacca | atcgaggtct |
| 2101 | ggtccgatct | cccctgcgag | tattccaggt | agccagatgc | ctccgcaacc | acctggaagc |
| 2161 | cagtcagaat | ccagttccca | tcctgccttg | agccagtcac | caatgccaca | ggaaagaggt |
| 2221 | tttatgacag | gcactcagag | aaaccctcag | atgtctcagt | acggacctca | gcagacagga |
| 2281 | ccatccatgt | cgcctcaccc | atctcctggg | ggccagatgc | atcctgggat | cagtaacttt |
| 2341 | cagcagagta | actcaagtgg | cacgtacggc | ccacagatga | gccagtatgg | accccaaggc |
| 2401 | aactactcca | gaaccccaac | atatagcggg | gtacccagtg | caagctacag | cggcccaggg |
| 2461 | cccggtatgg | gcatcaatgc | caacaaccag | atgcatggac | aagggccagc | ccagccatgt |
| 2521 | ggtgctatgc | ccctgggacg | aatgccttca | gctgggatgc | agaacagacc | atttcctgga |
| 2581 | accatgagca | gcgtcacccc | cagttctcct | ggcatgtctc | aacagggagg | gccaggaatg |
| 2641 | ggcccaccaa | tgcccactgt | gaaccggaag | gcccaggaag | ctgccgcagc | tgtgatgcag |
| 2701 | gctgctgcaa | actcagcaca | aagcaggcaa | ggcagttttc | ctggcatgaa | ccagagtggc |
| 2761 | ctggtggcct | ccagctctcc | ctacagccag | tccatgaaca | caactccag | cctgatgagc |
| 2821 | acccaggccc | agccctacag | catgacgccc | acaatggtga | acagctccac | agcatctatg |
| 2881 | ggtcttgcag | atatgatgtc | tcccagtgag | tccaaattgt | ctgtgcctct | taaagcagat |
| 2941 | ggtaaagaag | aaggcgtgtc | ccagcctgag | agcaagtcaa | aggacagcta | tggctctcag |
| 3001 | ggcatttccc | agcctccaac | ccaggcaac | ctgcctgtcc | cttccccaat | gtctcccagc |
| 3061 | tctgccagca | tctcctcctt | tcatggagat | gagagtgaca | gcattagcag | cccaggctgg |
| 3121 | cccaagacac | catcaagccc | taagtccagc | tcttcctcca | ccactgggga | gaagatcacg |
| 3181 | aaggtctatg | agctggggaa | tgagccggag | aggaagctgt | gggtcgaccg | ttacctaacg |
| 3241 | ttcatggaag | agaggggctc | cccggtgtcc | agtctgccag | cagtgggcaa | gaagcccctg |
| 3301 | gacctgttcc | gactgtatgt | ctgcgtcaag | gagattggag | gtttggcgca | ggttaataaa |
| 3361 | aacaagaagt | ggcgtgagct | ggcaaccaac | ctgaacgttg | gcacttccag | cagcgcagcc |
| 3421 | agctctctga | aaaagcagta | tattcagtac | ctgttcgcct | ttgagtgcaa | aactgagcgc |
| 3481 | ggggaggagc | ccccaccctga | agtcttcagc | accggggatt | cgaagaagca | gccaaagctc |
| 3541 | cagccgccat | ctcctgctaa | ctcaggatcc | ttacaaggcc | cacagactcc | acagtcaact |
| 3601 | gggagcaatt | cgatggcaga | ggttccaggt | gacctgaagc | caccaacccc | agcctctacc |
| 3661 | cctcatggac | agatgactcc | catgcaaagc | ggaagaagca | gtacagtcag | tgtgcatgac |
| 3721 | ccgttctcag | acgtgagtga | ctcagcgtac | ccaaaacgga | actccatgac | tccaaacgcc |
| 3781 | ccataccagc | agggcatggg | catgccagac | atgatgggca | ggatgcccta | tgaacccaac |
| 3841 | aaggaccctt | tcagtggaat | gagaaaagtg | cctggaagta | gtgagccctt | tatgacacaa |
| 3901 | ggacaggtgc | ccaacagcgg | catgcaggac | atgtacaacc | agagccctc | aggggccatg |
| 3961 | tccaatctgg | gcatgggaca | gcggcagcag | tttccctatg | gaaccagtta | tgaccgaagg |
| 4021 | catgaggctt | acggacagca | gtacccaggc | caaggccctc | ccacaggaca | gccaccgtat |
| 4081 | ggaggacacc | agcctggcct | gtacccacag | cagccgaatt | acaaacgtca | tatggatggc |
| 4141 | atgtacgggc | ctccagccaa | gcggcacgag | ggagacatgt | acaacatgca | gtatggcagc |
| 4201 | cagcagcagg | agatgtataa | ccagtatgga | ggctcctact | ctggccccga | cagaaggccc |
| 4261 | atccagggac | aatatcccta | cccctacaac | agagaaagga | tgcagggccc | aggccagatg |

TABLE 1-continued

```
4321  cagccacacg gaatcccacc tcagatgatg gggggcccca tgcagtcatc ctccagcgag
4381  gggcctcagc agaacatgtg ggctacacgc aacgatatgc cttatcccta ccagagcagg
4441  caaggcccgg gcggccctgc acaggccccc ccttacccag gcatgaaccg cacagatgat
4501  atgatggtac ctgagcagag gatcaatcac gagagccagt ggccttctca cgtcagccag
4561  cgccagcctt acatgtcatc ttcggcctcc atgcagccca tcacgcgccc acctcagtca
4621  tcctaccaga cgccgccgtc actgccaaac cacatctcca gggcaccag ccccgcctcc
4681  ttccagcgct ccctggagag tcgcatgtct ccaagcaagt ctcccttcct gcccaccatg
4741  aagatgcaga aggtcatgcc cacagtcccc acatcccagg tcaccgggcc cccccacag
4801  cctccaccaa tcagaaggga gattaccttt cctcctggct ccgtagaagc atcacagcca
4861  atcctgaaac aaaggcgaaa gattacctca aaagatattg ttactcccga ggcgtggcgt
4921  gtgatgatgt cccttaaatc gggtctgttg gctgagagca cgtgggctct ggacaccatc
4981  aatattctcc tctatgatga cagcaccgtc gccaccttca atctttccca gctgtctgga
5041  ttcctggaac tattagtaga gtactttcga aaatgcctaa ttgacatttt cggaattctt
5101  atgaatatg aagtgggtga ccccagccaa aaggctcttg atcaccgttc agggaagaaa
5161  gatgacagcc agtccctgga agatgattct gggaaggaag acgatgatgc tgagtgtctt
5221  gtggaagagg aggaggagga agaggaggag gaggaagaca gtgaaaagat agagtcagag
5281  gggaagagca gccctgccct agctgctcca gatgcctccg tggacccaa ggagacgcca
5341  aagcaggcca gtaagtttga caagctgccc ataaagattg tcaaaaagaa caagctgttt
5401  gtggtggacc ggtccgacaa gctgggccga gtgcaggagt tcagcagcgg gctcctccac
5461  tggcagctgg gtggtggcga cactaccgag cacatccaga ctcacttcga gagcaagatg
5521  gagatccctc ctcgcaggcg tccacctccg cctctaagct ccacgggtaa gaagaaagag
5581  ctggaaggca aaggtgattc tgaagagcag ccagagaaaa gtatcatagc caccatcgat
5641  gacgtcttgt ctgcccggcc aggggctctg cctgaagaca ccaacccagg accccagacc
5701  gacagcggca gtttcccctt tggaatccag caggccaaaa gccaccggaa catcaggctc
5761  ctggaagacg agcccaggag ccgagacgag acgccgctgt gcaccatcgc gcactggcag
5821  gactcactgg ccaagcgctg catctgtgtg tcgaacatcg tgcggagctt gtctttcgtg
5881  cctggcaacg acgcagagat gtccaaacac ccgggcttgg tgctgatcct gggaaagctg
5941  attctgctgc atcacgagca tccggagaga aagcgggcgc cacagaccta tgagaaggag
6001  gaggacgagg acaaggggt ggcctgcagc aaagatgagt ggtggtggga ctgcctcgag
6061  gtcttgcggg ataacaccct ggtcacgttg gcgaacattt ccggggcagct agacttgtct
6121  gcttacacag agagcatctg cttgccgatc ctgacggct tgctacactg gatggtgtgc
6181  ccgtccgcag aggctcagga cccctttccc actgtggggc ccaactcagt cctgtcgccg
6241  cagagacttg tgctggagac cctgtgtaaa ctcagtatcc aggacaacaa cgtggacctg
6301  atcttggcca cgcctccatt tagtcgtcag gagaaatttt atgctacatt agttaggtac
6361  gttggggatc gcaaaaatcc agtctgtcga gaaatgtcca tggcgctttt atcgaacctt
6421  gcccagggg acacactggc ggcgagggca atagctgtgc agaaaggaag cattggtaac
6481  ttgataagct tcctagagga cggggtgacg atggcgcagt accagcagag ccagcataac
6541  cttatgcaca tgcagccccc acctctggaa ccccctagtg tagacatgat gtgccgggcg
6601  gccaaagctc tgctggccat ggccagagtg gacgagaacc gctcggagtt ccttttgcac
6661  gagggtcggt tgctggatat ctcaatatca gctgtcctga actctctggt tgcatctgtc
```

TABLE 1-continued

```
6721  atctgtgatg tactgtttca gattgggcag ttatgacatc cgtgaaggca cacatgtgtg
6781  agtgaacatt agagggtcac atataactgg ctgttttctg ttctcgttta tccagtgtaa
6841  gaagaaggaa aagaaaaatc tttgctcctc tgccccgttt actatttacc aattgggaat
6901  taaatcatta atttgaacag ttataaaatt aatatttgct gtctgtgtgt ataagtacat
6961  cctctggcgg ttttctgttt cttttttttt taaccaaagt tgccgtctag tgcattcaaa
7021  ggtcacaatt tttgtttgtt tgtttgtttg tttgtttttt cataattttt ttcatgttgt
7081  attgcagtct ttgggaagtg aattgacttt ataaagaaaa acgttttggc aaaaagtgct
7141  aagatagaaa aatgtcacca cactgggtca aaaacgtgaa aggaaaaatt gattcttaaa
7201  ttgatttcct atgaatttta ttcttcacag aatgataaaa gctaaactgc accccgtcac
7261  ccaaagctct gtgcaataga aacttctaga gatatagtgt aggggctgaa ggaggtatgg
7321  cagcagtagt cagggtcaat gatactgctt tctccaccgg aaagtggtta cgttaggcct
7381  cgagcaaaaa acagcgctct cagataggtg caaaaatcca ctcctagcag ccaacagcag
7441  gatcgcttcc tcaccacgac cgccatgtct gctgtggctc agcctccacg ggacaaagct
7501  tcaagatttc tttcatcatt ttttttaaata ttttttttac tgcctatggg ctgtgatgta
7561  tatagaagtt gtacattaaa catacccctca ttttttttctt cttttcttttt tttctttttt
7621  tcttttttctt tttttttttt tttagtacaa agttttttagt ttcttttttca tgatgtggta
7681  actacgaagt gatggtagat ttaaataatt tttttatttttt attttatata tttttttcatt
7741  aggaccatat ctccaaaaaa caagaaaaag aaacaaaaaa tacaaaaaat aaaaacaaac
7801  aaaaaaagag ggtaatgtac aagtttctgt atgtataaag tcatgctctg ttgggagagc
7861  ggctgatccc agtttgcttc atgaatcaaa gtgtggaaat ggttgcatac agattgattt
7921  agaaaatgga caccagtaca tacaaaaaaa gaaaaaagaa agaaaaccaa ctaaatggaa
7981  gaaacacaac ttcaaagatt tttctgtgac aagaatccac atttgtattt caagataatg
8041  tagtttaaga aaagaaaaaa aagaaaaaaa aagaaaaaaa cttgatgtaa attcctcctt
8101  ttcctctggc ttaatgaata tcatttattc agtataaaat ctttatatgt cccacatgtt
8161  aagaataaat gtacattaaa tcttgttacg cactgtgatg ggtgttcttg aatgctgttc
8221  tagtttgcct agcatggttg ccatagtaac caagttattt acaggaaata gggaagatgt
8281  aacaactgct tcctggtaat gatgcccaaa ggccagaagg gactttcagg gtttcctact
8341  tgagagtggg agcaacaatt tgattttctc agattgttta gctaattagg tcttctttga
8401  agcaattaac tctggtgaca ttgagaagtg gtaattccct catggatggg tggtggctgc
8461  caacccactg tgacatgggg ccctgcaagc taactggcct gaaaccacga ccttctgcct
8521  ctcactactg atttaaccca agtctgcacc cgtcatgttt cttctgtgtg cctccaagtt
8581  actctgcgtt agtttgctcc agcgtgtata atatttatat tgtgcaatgt taaagagaac
8641  gtgtcatatt gtatgccgtg tgtatagtgc caagtgatga ttctgtttca gagcatacct
8701  tccttcctgc ccagtccctg gctctctaat accccaccct gatggaaagt gcttcttcct
8761  gggtaattga ctgttactgt gtaacgctca gtctcattga aacttacata accatgctgc
8821  tggtgcccct tcctaccctc cctctctcag cactcttcag ttgacacttc ccacacctgt
8881  cactgtggcc caccttgctc acgctgacat ctggaagagt tagacaggag cacacactta
8941  caacactagg agatgttatt ctggtgtcac gagaaagaaa ttggttttttc ctgcaaacag
9001  tcccatcacc aagcagcccc cacatcaggt cagcaaaaag atctgtgttg aatcaaaact
9061  ccatttataa ttctactaga tgggaataca tctgcttaca aaggacagat tttagtgttc
```

TABLE 1-continued

```
 9121  tgtgatgaaa atatggagag tgcaagagag agttcaatgg aatcctaatc ttgctcttgc
 9181  agacaatgaa tgaaaggtat agacaggctc agttccctgt cagaagagtg gtctcaaaga
 9241  caagtggctg tatagcagcc aggcccagaa cagcctcgca gcacacacta acaccaagcg
 9301  ggtgtctgag ctctcctagg aagccttgtg cctgccctcc ctccattcac ccagatccga
 9361  ctcctggaag cccacgaaag agtcacccct tgcttcacat ttcctgacga taccgagttg
 9421  ctgctctgtc ctaaaaatat tagttctttt ccagggcttt cagaaatttg caggatgccc
 9481  atactctaaa tgtgtaccaa aagagagag aaataaaggt gcgaagaaag tttagtattt
 9541  tggaatggtg cgataaaatg gaatctgttg gtttttaatg taacataaga tactattggc
 9601  tggcactggc taaaaaaaat atctaagtgt tggagttgga tgcacaatca acttttactt
 9661  agctattcaa agagtactta tgttttccaa gttaaaacag acttgttttt gacaggggcc
 9721  gtgggtggtc ttatacaatg ccagctccta actgcagctt ctgagaactg gatatcgttt
 9781  gccctgagag ctgcccgtct ccaactatgt gctgctgctg ccctgtgtgc tcagcccaca
 9841  aggatgtgga gactggatag acaaccccct tgcttcttgct gggttgtgct gagttctttg
 9901  cagtccagtc aagtgcccag agctaccagc ctacgtccct catgcatcca agagaaatga
 9961  tcttgactat catgatcaaa acagctgtag taatatttct agtaaatatt tctgatgact
10021  ctgtgtaatc tcctacaaca ggacactatt cattaacttg acagagacat gtgggcatgt
10081  ggtcctgctt tagtttaaca gacaagtcaa ccagttctca ttacttagga agagtgaggc
10141  tatgtctgtt acaatcccaa tgtggtgctt gcccttatcc aaagacagtc cgggggccct
10201  gtctgcctga actatgtctc gctccctctt gggcttccca ctgggatgtg aaaagataac
10261  caatggctcc caggttccca gtgcccccca aaccagtaat caggtctggg actacagaac
10321  ccgcaaaatc atacacaggc tgtttcaaag ccagtactct ctttatactc ctgcttcctc
10381  cagcccccat ttcacacccc acccaaatca caaggtcctc tgaagtctca gaactccaaa
10441  ttaacgttgg gatttacgat gtgaatgcta aggagaaaat tgggagttgg tgggagatca
10501  ccaaattgtc aaaactatga aactcatctg tcttcccaaa tctgacctca gggacttggg
10561  gggttcactc tggcttctgc cacagtattt tctggggaac caaaggcctc gggaatagag
10621  aaacaggttg ccggatatcc tggaagtcta agccatactg accagtttgt cttgagtgtt
10681  ttctttgtga gcctggaact gtccccggac ccctttcttt taaacatggt tcaggacttt
10741  aaaaaaaagc actgtatttt ttttatgtaa gccaagatgc cctccctagc agagatagcg
10801  ttgaactgtc tctagttctg tagcctgaga gacttaaatc gtttaacttc agtgtctttg
10861  tccactctgt tgaactgcta aggattctat tgaatgtgtt ctttgcggct ttggaggagt
10921  tgctgggtgt gtaagtcctg catccctttg cctggtatgt gtatattatt cctttgcctg
10981  gctgtgtatc gttcttcagt gtaagtacac ccacactctg tattcctttg cctgctcccc
11041  gccccccac acacacacat cctgcatagt tttaaaataa ggcctgagag actgtttcta
11101  tttcctgtca tagctggtga cttttaacag ttgaggcgaa tggcctgtca cttgcctggg
11161  ttcccgtcag gggtgatcca tggaactcct cagtggaaca gaatttagga cagaagatcc
11221  caccttcctt ccaggcctgg ggagaatcag actgtgagat aaaccatgat gctgcccaat
11281  cccactgccc caccttgctt ttaaaataaa gtgcctccta acgtc
```

SEQ ID NO: 42 Mouse ARID1B Amino Acid Sequence (NP_001078824.1)

```
  1  metgllpnhk lkavgeapaa pphqqhhhhh ahhhhhhhah hlhhlhhhha lqqqlnqfqg
 61  pqppqpqqqq pppppqqqhp tannslggag ggapqpgpdm eqpqhggakd svagnqadpq
121  gqpllskpgd eddappkmge pagsryehpg lgaqqqpapv avpggggpa aysefnnyyg
```

TABLE 1-continued

```
 181  saapasggpg gragpcfdqh ggqqspgmgm mhsasaaaga pssmdplqns hegypnsqyn
 241  hypgysrpga gggggggggg ggsggggggg gaggaggaaa aaagagavaa aaaaaaaaaa
 301  aagggggggy gssssgygvl ssprqqgggm mmgpggggaa slskaaagaa aaaggfqrfa
 361  gqnqhpsgat ptlnqlltsp spmmrsyggs ypdyssssap pppsqpqsqa aagaaaggqq
 421  aaagmglgkd lgaqyaaasp awaaaqqrsh pamspgtpgp tmgrsqgspm dpmvmkrpql
 481  ygmgthphsq pqqsspypgg sygppgaqry plgmqgrapg alglgypqg qmppqygqqa
 541  vsgycqqgqq pyynqqpqps hlppgagylq paaaqsqqry qpqqdmsgeg ygtrsqppla
 601  pgksnhedln liggerpssl pdlsgsiddl ptgteatlss aysasgstss qgdqsnpaqs
 661  pfsphasphl ssipggpsps pvgspvgsnq srsgpispas ipgsqmppqp pgsqsesssh
 721  palsgspmpq ergfmtgtqr npqmsqygpq qtgpsmsphp spggqmhpgi snfqqsnssg
 781  tygpqmsqyg pqgnysrtpt ysgvpsasys gpgpgmgina nnqmhgqgpa qpcgamplgr
 841  mpsagmqnrp fpgtmssvtp sspgmsqqgg pgmgppmptv nrkaqeaaaa vmqaaansaq
 901  srqgsfpgmn qsglvasssp ysqsmnnnss lmstqaqpys mtptmvnsst asmgladmms
 961  pseskslvpl kadgkeegvs qpeskskdsy gsqgisqppt pgnlpvpspm spssasissf
1021  hgdesdsiss pgwpktpssp kssssttge kitkvyelgn eperklwvdr yltfmeergs
1081  pvsslpavgk kpldlfrlyv cvkeigglaq vnknkkwrel atnlnvgtss saasslkkqy
1141  iqylfafeck tergeeppe vfstgdskkq pklqppspan sgslqgpqtp qstgsnsmae
1201  vpgdlkpptp astphgqmtp mqsgrsstvs vhdpfsdvsd saypkrnsmt pnapyqqgmg
1261  mpdmmgrmpy epnkdpfsgm rkvpgssepf mtgqvpnsg mgdmyngsps gamsnlgmgq
1321  rqqfpygtsy drrheayggq ypgqgpptgq ppygghqpgl ypqqpnykrh mdgmygppak
1381  rhegdmynmq ygsqqqemyn qyggsysgpd rrpiqggypy pynrermqgp gqmqphgipp
1441  qmmggpmqss ssegpqqnmw atrndmpypy qsrqgpggpa qappypgmnr tddmmvpeqr
1501  inhesqwpsh vsqrqpymss sasmqpitrp pgssyqtpps lpnhisraps pasfqrsles
1561  rmspskspfl ptmkmqkvmp tvptsqvtgp ppqpppirre itfppgsvea sqpilkqrrk
1621  itskdivtpe awrvmmslks gllaestwal dtinillydd stvatfnlsq lsgflellve
1681  yfrkclidif gilmeyevgd psqkaldhrs gkkddsgsle ddsgkeddda eclveeeeee
1741  eeeeedseki esegksspal aapdasvdpk etpkqaskfd klpikivkkn klfvvdrsdk
1801  lgrvqefssg llhwqlgggd ttehigthfe skmeipprrr pppplsstgk kkelegkgds
1861  eeqpeksiia tiddvlsarp galpedtnpg pqtdsgkfpf giqqakshrn irlledeprs
1921  rdetplctia hwqdslakrc icvsnivrsl sfvpgndaem skhpglvlil gklillhheh
1981  perkrapqty ekeededkgv acskdewwwd clevlrdntl vtlanisgql dlsaytesic
2041  lpildgllhw mvcpsaeaqd pfptvgpnsv lspqrlvlet lcklsiqdnn vdlilatppf
2101  srgekfyatl vryvgdrknp vcremsmall snlaqgdtla araiavqkgs ignlisfled
2161  gvtmagyqqs qhnlmhmqpp pleppsvdmm craakallam arvdenrsef llhegrlldi
2221  sisavinslv asvicdvlfq igql
```

SEQ ID NO: 43 Human CRB1 cDNA Sequence Variant 1 (NM_201253.2, CDS: from 210 to 4430)

```
   1  cctcccgtgt aagtgatgct aagaagcaca aactgcattt tgaatctaag tccctgtatt
  61  ttctgtgaag gagctgtaag tagggtggga cagagatggc acctgggggt tctgaggcac
 121  ccgctcctct ctgagacaga cagggatcag gagccggact gggaccagac caccagcaac
 181  acaccagagg atgttctcta aataagacca tggcacttaa gaacattaac taccttctca
```

TABLE 1-continued

```
 241  tcttctacct cagtttctca ctgcttatct acataaaaaa ttccttttgc aataaaaaca
 301  acaccaggtg cctctcaaat tcttgccaaa acaattctac atgcaaagat ttttcaaaag
 361  acaatgattg ttcttgttca gacacagcca ataatttgga caaagactgt gacaacatga
 421  aagacccttg cttctccaat ccctgtcaag gaagtgccac ttgtgtgaac accccaggag
 481  aaaggagctt tctgtgcaaa tgtcctcctg ggtacagtgg acaatctgt gaaactacca
 541  ttggttcctg tggcaagaac tcctgccaac atggaggtat ttgccatcag gaccctattt
 601  atcctgtctg catctgccct gctggatatg ctggaagatt ctgtgagata gatcacgatg
 661  agtgtgcttc cagcccttgc caaaatgggg ccgtgtgcca ggatggaatt gatggttact
 721  cctgcttctg tgtcccagga tatcaaggca gacactgcga cttggaagtg gatgaatgtg
 781  cttcagatcc ctgcaagaac gaggctacat gcctcaatga ataggaaga tatacttgta
 841  tctgtcccca caattattct ggtgtaaact gtgaattgga aattgacgaa tgttggtccc
 901  agccttgttt aaatggtgca acttgtcagg atgctctggg ggcctatttc tgcgactgtg
 961  cccctggatt cctgggggat cactgtgaac tcaacactga tgagtgtgcc agtcaacctt
1021  gtctccatgg agggctgtgt gtggatggaa aaacagata tagctgtaac tgcacgggta
1081  gtggattcac agggacacac tgtgagacct tgatgcctct tgttggtca aaaccttgtc
1141  acaataatgc tacatgtgag gacagtgttg acaattacac ttgtcactgc tggcctggat
1201  acacaggtgc ccagtgtgag atcgacctca atgaatgcaa tagtaacccc tgccagtcca
1261  atgggggaatg tgtggagctg tcctcagaga acaatatgg acgcatcact ggactgcctt
1321  cttctttcag ctaccatgaa gcctcaggtt atgtctgtat ctgtcagcct ggattcacag
1381  gaatccactg cgaagaagac gtcaatgaat gttcttcaaa cccttgccaa aatggtggta
1441  cttgtgagaa cttgcctggg aattatactt gccattgccc atttgataac ctttctagaa
1501  cttttatgg aggaagggac tgttctgata ttctcctggg ctgtacccat cagcaatgtc
1561  taaataatgg aacatgcatc cctcacttcc aagatggcca gcatggattc agctgcctgt
1621  gtccatctgg ctacaccggg tccctgtgtg aaatcgcaac cacactttca tttgagggcg
1681  atggcttcct gtgggtcaaa agtggctcag tgacaaccaa gggctcagtt tgtaacatag
1741  ccctcaggtt tcagactgtt cagccaatgg ctcttctact tttccgaagc aacagggatg
1801  tgtttgtgaa gctggagctg ctaagtggct acattcactt atcaattcag gtcaataatc
1861  agtcaaaggt gcttctgttc atttcccaca acaccagcga tggagagtgg catttcgtgg
1921  aggtaatatt tgcagaggct gtgaccctta ccttaatcga cgactcctgt aaggagaaat
1981  gcatcgcgaa agctcctact ccacttgaaa gtgatcaatc aatatgtgct tttcagaact
2041  cctttttggg tggtttacca gtgggaatga ccagcaatgg tgttgctctg cttaacttct
2101  ataatatgcc atccacacct tcgtttgtag gctgtctcca agacattaaa attgattgga
2161  atcacattac cctggagaac atctcgtctg gctcatcatt aaatgtcaag gcaggctgtg
2221  tgagaaagga ttggtgtgaa agccaacctt gtcaaagcag aggacgctgc atcaacttgt
2281  ggctgagtta ccagtgtgac tgccacaggc cctatgaagg ccccaactgt ctgagagagt
2341  atgtggcagg cagatttggc caggatgact ccactggtta tgtcatcttt actcttgatg
2401  agagctatgg agacaccatc agcctctcca tgtttgtccg aacgcttcaa ccatcaggct
2461  tacttctagc tttggaaaac agcacttatc aatatatccg tgtctggcta gagcgcggca
2521  gactagcaat gctgactcca aactctccca aattagtagt aaatttgtt cttaatgatg
2581  gaaatgtcca cttgatatct ttgaaaatca agccatataa aattgaactg tatcagtctt
```

TABLE 1-continued

```
2641  cacaaaacct aggatttatt tctgcttcta cgtggaaaat cgaaaaggga gatgtcatct
2701  acattggtgg cctacctgac aagcaagaga ctgaacttaa tggtggattc ttcaaaggct
2761  gtatccaaga tgtaagacta acaaccaaa atctggaatt ctttccaaat ccaacaaaca
2821  atgcatctct caatccagtt cttgtcaatg taacccaagg ctgtgctgga cacacagct
2881  gcaagtccaa cccctgtcac aatggaggtg tttgccattc ccggtgggat gacttctcct
2941  gttcctgtcc tgccctcaca agtgggaaag cctgtgagga ggttcagtgg tgtggattca
3001  gcccgtgtcc tcacggagcc cagtgccagc cggtgcttca aggatttgaa tgtattgcaa
3061  atgctgtttt taatggacaa agcggtcaaa tattattcag aagcaatggg aatattacca
3121  gagaactcac caatatcaca tttggtttca gaacaaggga tgcaaatgta ataatattgc
3181  atgcagaaaa agagcctgaa tttcttaata ttagcattca agattccaga ttattctttc
3241  aattgcaaag tggcaacagc ttttatatgc taagtctgac aagtttgcag tcagtgaatg
3301  atggcacatg gcacgaagtg acccttccca tgacagaccc actgtcccag acctccaggt
3361  ggcaaatgga agtggacaac gaaacacctt ttgtgaccag cacaattgct actggaagcc
3421  tcaactttt gaaggataat acagatattt atgtgggaga cagagctatt gacaatataa
3481  agggcctgca agggtgtcta agtacaatag aaatcggagg catttatctc tcttactttg
3541  aaaatgttca tggtttcatt aataaacctc aggaagagca atttctcaaa atctctacca
3601  attcagtggt cactggctgt ttgcagttaa atgtctgcaa ctccaacccc tgtttgcatg
3661  gaggaaactg tgaagacatc tatagctctt atcattgctc ctgtcccttg ggatggtcag
3721  ggaaacactg tgaactcaac atcgatgaat gcttttcaaa cccctgtatc catggcaact
3781  gctctgacag agttgcagcc taccactgca catgtgagcc tggatacact ggtgtgaact
3841  gtgaagtgga tatagacaac tgccagagtc accagtgtgc aaatggagcc acctgcatta
3901  gtcatactaa tggctattct tgcctctgtt ttggaaattt tacaggaaaa ttttgcagac
3961  agagcagatt accctcaaca gtctgtggga atgagaagac aaatctcact tgctacaatg
4021  gaggcaactg cacagagttc cagactgaat taaaatgtat gtgccggcca ggttttactg
4081  gagaatggtg tgaaaaggac attgatgagt gtgcctctga tccgtgtgtc aatggaggtc
4141  tgtgccagga cttactcaac aaattccagt gcctctgtga tgttgccttt gctggcgagc
4201  gctgcgaggt ggacttggca gatgacttga tctccgacat tttcaccact attggctcag
4261  tgactgtcgc cttgttactg atcctcttgc tggccattgt tgcttctgtt gtcacctcca
4321  acaaagggc aactcaggga acctacagcc ccagccgtca ggagaaggag ggctcccgag
4381  tggaaatgtg gaacttgatg ccacccctg caatggagag actgatttag gagcattgtg
4441  tcccttcgag atggggatcc acacactgtg aatgtgatga ctgtacttca ggtatctctg
4501  acatacctga caatgttaat ctgcaactgg gattacactg gaactacagg aatgattcct
4561  ttgaccacct taaaaacttt cacagtggtt ccgctcgaca ccattgtttt attatattat
4621  atcagccaat tgcaaaaaaa gtctgtgcca gtaatttcag ccttataatt agcaaaaaca
4681  tcttccagag aataaagtct tctgtggctt tagtggctat cactgaaact ctttcctctt
4741  ttcaacctgg gaacaaattt tagttttcat tttaggtttc tgtactttct gtagtttctg
4801  tgtaaactgc catatgttta catggaaact acaggaaaaa attggctaca tttctcactt
4861  ctcctatcat gtggtcaaag ttattgttgt ataccagcga tgggatgtat acttttgtcc
4921  ttcattcatg gattcagaga aagctctggg aatgacttat ggtccaaaaa agtgacccaa
4981  tggcaacaaa taaaaattga aatgcaaaaa aaaaaaaaaa aaaa
```

TABLE 1-continued

```
SEQ ID NO: 44 Human CRB1 Amino Acid Sequence Isoform A (NP_957705.1)
   1 malkninyll ifylsfslli yiknsfcnkn ntrclsnscq nnstckdfsk dndcscsdta
  61 nnldkdcdnm kdpcfsnpcq gsatcvntpg ersflckcpp gysgticett igscgknscq
 121 hggichqdpi ypvcicpagy agrfceidhd ecasspcqng avcgdgidgy scfcvpgyqg
 181 rhcdlevdec asdpckneat clneigrytc icphnysgvn celeidecws qpclngatcq
 241 dalgayfcdc apgflgdhce lntdecasqp clhgglcvdg enryscnctg sgftgthcet
 301 lmplcwskpc hnnatcedsv dnytchcwpg ytgagceidl necnsnpcqs ngecvelsse
 361 kqygritglp ssfsyheasg yvcicqpgft gihceedvne cssnpcqngg tcenlpgnyt
 421 chcpfdnlsr tfyggrdcsd illgcthqqc lnngtciphf qdgqhgfscl cpsgytgslc
 481 eiattlsfeg dgflwvksgs vttkgsvcni alrfqtvgpm alllfrsnrd vfvklellsg
 541 yihlsiqvnn qskvllfish ntsdgewhfv evifaeavtl tliddsckek ciakaptple
 601 sdqsicafqn sflgglpvgm tsngvallnf ynmpstpsfv gclqdikidw nhitleniss
 661 gsslnvkagc vrkdwcesqp cgsrgrcinl wlsyqcdchr pyegpnclre yvagrfgqdd
 721 stgyviftld esygdtisls mfvrtlqpsg lllalensty qyirvwlerg rlamltpnsp
 781 klvvkfvind gnvhlislki kpykielyqs sqnlgfisas twkiekgdvi yigglpdkqe
 841 telnggffkg ciqdvrinnq nleffpnptn naslnpvlvn vtqgcagdns cksnpchngg
 901 vchsrwddfs cscpaltsgk aceevqwcgf spcphgaqcq pvlqgfecia navfngqsgq
 961 ilfrsngnit reltnitfgf rtrdanviil haekepefln isiqdsrlff qlgsgnsfym
1021 lsltslgsvn dgtwhevtls mtdplsqtsr wqmevdnetp fvtstiatgs lnflkdntdi
1081 yvgdraidni kglqgclsti eiggiylsyf envhgfinkp geegflkist nsvvtgclql
1141 nvcnsnpclh ggncediyss yhcscplgws gkhcelnide cfsnpcihgn csdrvaayhc
1201 tcepgytgvn cevdidncqs hqcangatci shtngyscic fgnftgkfcr qsrlpstvcg
1261 nektnitcyn ggnctefqte lkcmcrpgft gewcekdide casdpcvngg lcqdllnkfq
1321 cicdvafage rcevdladdl isdifttigs vtvallllil laivasvvts nkratqgtys
1381 psrqekegsr vemwnlmppp amerli
SEQ ID NO: 45 Human CRB1 cDNA Sequence Variant 2 (NM_001193640.1, CDS:
from 210 to 4094)
   1 cctcccgtgt aagtgatgct aagaagcaca aactgcattt tgaatctaag tccctgtatt
  61 ttctgtgaag gagctgtaag tagggtggga cagagatggc acctgggggt tctgaggcac
 121 ccgctcctct ctgagacaga cagggatcag gagccggact gggaccagac caccagcaac
 181 acaccagagg atgttctcta ataagaccag tggcacttaa gaacattaac taccttctca
 241 tcttctacct cagtttctca ctgcttatct acataaaaaa ttccttttgc aataaaaaca
 301 acaccaggtg cctctcaaat tcttgccaaa acaattctac atgcaaagat ttttcaaaag
 361 acaatgattg ttcttgttca gacacagcca ataatttgga caaagactga gacaacatga
 421 aagacccttg cttctccaat ccctgtcaag gaagtgccac ttgtgtgaac accccaggag
 481 aaaggagctt tctgtgcaaa tgtcctcctg ggtacagtgg acaatctgtg aaactacca
 541 ttggttcctg tggcaagaac tcctgccaac atggaggtat ttgccatcag accctatttt
 601 atcctgtctg catctgccct gctggatatg ctggaagatt ctgtgagata gatcacgatg
 661 agtgtgcttc cagcccttgc caaaatgggg ccgtgtgcca ggatggaatt gatggttact
 721 cctgcttctg tgtcccagga tatcaaggca gacactgcga cttggaagtg gatgaatgtg
 781 cttcagatcc ctgcaagaac gaggctacat gctcaatga ataggaagaa tatacttgta
 841 tctgtcccca caattattct ggatacacag gtgcccagtg tgagatcgac ctcaatgaat
```

TABLE 1-continued

```
 901  gcaatagtaa ccectgccag tccaatgggg aatgtgtgga gctgtcctca gagaaacaat
 961  atggacgcat cactggactg ccttcttctt tcagctacca tgaagcctca ggttatgtct
1021  gtatctgtca gcctggattc acaggaatcc actgcgaaga agacgtcaat gaatgttctt
1081  caaacccttg ccaaaatggt ggtacttgtg agaacttgcc tgggaattat acttgccatt
1141  gcccatttga taacctttct agaactttt atggaggaag ggactgttct gatattctcc
1201  tgggctgtac ccatcagcaa tgtctaaata atggaacatg catccctcac ttccaagatg
1261  gccagcatgg attcagctgc ctgtgtccat ctggctacac cgggtccctg tgtgaaatcg
1321  caaccacact ttcatttgag ggcgatggct tcctgtgggt caaaagtggc tcagtgacaa
1381  ccaagggctc agtttgtaac atagccctca ggtttcagac tgttcagcca atggctcttc
1441  tacttttccg aagcaacagg atgtgtttg tgaagctgga gctgctaagt ggctacattc
1501  acttatcaat tcaggtcaat aatcagtcaa aggtgcttct gttcatttcc cacaacacca
1561  gcgatggaga gtggcatttc gtggaggtaa tatttgcaga ggctgtgacc cttaccttaa
1621  tcgacgactc ctgtaaggag aaatgcatcg cgaaagctcc tactccactt gaaagtgatc
1681  aatcaatatg tgcttttcag aactcctttt tgggtggttt accagtggga atgaccagca
1741  atggtgttgc tctgcttaac ttctataata tgccatccac accttcgttt gtaggctgtc
1801  tccaagacat taaaattgat tggaatcaca ttaccctgga gaacatctcg tctggctcat
1861  cattaaatgt caaggcaggc tgtgtgagaa aggattggtg tgaaagccaa ccttgtcaaa
1921  gcagaggacg ctgcatcaac ttgtggctga gttaccagtg tgactgccac aggccctatg
1981  aaggccccaa ctgtctgaga gagtatgtgg caggcagatt tggccaggat gactccactg
2041  gttatgtcat ctttactctt gatgagagct atggagacac catcagcctc tccatgtttg
2101  tccgaacgct tcaaccatca ggcttacttc tagctttgga aaacagcact tatcaatata
2161  tccgtgtctg gctagagcgc ggcagactag caatgctgac tccaaactct cccaaattag
2221  tagtaaaatt tgttcttaat gatggaaatg tccacttgat atctttgaaa atcaagccat
2281  ataaaattga actgtatcag tcttcacaaa acctaggatt tatttctgct tctacgtgga
2341  aaatcgaaaa gggagatgtc atctacattg tggcctacc tgacaagcaa gagactgaac
2401  ttaatggtgg attcttcaaa ggctgtatcc aagatgtaag actaaacaac caaaatctgg
2461  aattctttcc aaatccaaca aacaatgcat ctctcaatcc agttcttgtc aatgtaaccc
2521  aaggctgtgc tggagacaac agctgcaagt ccaacccctg tcacaatgga ggtgtttgcc
2581  attcccggtg ggatgacttc tcctgttcct gtcctgccct cacaagtggg aaagcctgtg
2641  aggaggttca gtggtgtgga ttcagcccgt gtcctcacgg agcccagtgc cagccggtgc
2701  ttcaaggatt tgaatgtatt gcaaatgctg ttttaatgg acaaagcggt caaatattat
2761  tcagaagcaa tgggaatatt accagagaac tcaccaatat cacatttggt ttcagaacaa
2821  gggatgcaaa tgtaataata ttgcatgcag aaaaagagcc tgaatttctt aatattagca
2881  ttcaagattc cagattattc tttcaattgc aaagtggcaa cagcttttat atgctaagtc
2941  tgacaagttt gcagtcagtg aatgatggca catggcacga agtgaccctt tccatgacag
3001  acccactgtc ccagacctcc aggtggcaaa tggaagtgga caacgaaaca ccttttgtga
3061  ccagcacaat tgctactgga agcctcaact ttttgaagga taatacagat atttatgtgg
3121  gagacagagc tattgacaat ataaagggcc tgcaagggtg tctaagtaca atagaaatcg
3181  gaggcattta tctctcttac tttgaaaatg ttcatggttt cattaataaa cctcaggaag
3241  agcaatttct caaaatctct accaattcag tggtcactgg ctgtttgcag ttaaatgtct
```

TABLE 1-continued

```
3301  gcaactccaa cccctgtttg catggaggaa actgtgaaga catctatagc tcttatcatt
3361  gctcctgtcc cttgggatgg tcagggaaac actgtgaact caacatcgat gaatgctttt
3421  caaaccoctg tatccatggc aactgctctg acagagttgc agcctaccac tgcacatgtg
3481  agcctggata cactggtgtg aactgtgaag tggatataga caactgccag agtcaccagt
3541  gtgcaaatgg agccacctgc attagtcata ctaatggcta ttcttgcctc tgttttggaa
3601  attttacagg aaaattttgc agacagagca gattaccctc aacagtctgt gggaatgaga
3661  agacaaatct cacttgctac aatggaggca actgcacaga gttccagact gaattaaaat
3721  gtatgtgccg gccaggtttt actgagaat ggtgtgaaaa ggacattgat gagtgtgcct
3781  ctgatccgtg tgtcaatgga ggtctgtgcc aggacttact caacaaattc cagtgcctct
3841  gtgatgttgc ctttgctggc gagcgctgcg aggtggactt ggcagatgac ttgatctccg
3901  acattttcac cactattggc tcagtgactg tcgccttgtt actgatcctc ttgctggcca
3961  ttgttgcttc tgttgtcacc tccaacaaaa gggcaactca gggaacctac agccccagcc
4021  gtcaggagaa ggagggctcc cgagtggaaa tgtggaactt gatgccaccc cctgcaatgg
4081  agagactgat ttaggagcat tgtgtcccct cgagatgggg atccacacac tgtgaatgtg
4141  atgactgtac ttcaggtatc tctgacatac ctgacaatgt taatctgcaa ctgggattac
4201  actggaacta caggaatgat tcctttgacc accttaaaaa ctttcacagt ggttccgctc
4261  gacaccattg ttttattata ttatatcagc caattgcaaa aaaagtctgt gccagtaatt
4321  tcagccttat aattagcaaa aacatcttcc agagaataaa gtcttctgtg ctttagtgg
4381  ctatcactga aactctttcc tcttttcaac ctgggaacaa attttagttt tcattttagg
4441  tttctgtact ttctgtagtt tctgtgtaaa ctgccatatg tttacatgga aactacagga
4501  aaaaattggc tacatttctc acttctccta tcatgtggtc aaagttattg ttgtatacca
4561  gcgatgggat gtatacttt gtccttcatt catggattca gagaaagctc tgggaatgac
4621  ttatggtcca aaaagtgac ccaatggcaa caataaaaa ttgaaatgca aaaaaaaaa
4681  aaaaaaaa
```

SEQ ID NO: 46 Human CRB1 Amino Acid Sequence Isoform B (NP_001180569.1)

```
  1  malkninyll ifylsfslli yiknsfcnkn ntrclsnscq nnstckdfsk dndcscsdta
 61  nnldkdcdnm kdpcfsnpcq gsatcvntpg ersflckcpp gysgticett igscgknscq
121  hggichqdpi ypvcicpagy agrfceidhd ecasspcqng avcgdgidgy scfcvpgyqg
181  rhcdlevdec asdpckneat clneigrytc icphnysgyt gaqceidlne cnsnpcgsng
241  ecvelssekq ygritglpss fsyheasgyv cicqpgftgi hceedvnecs snpcqnggtc
301  enlpgnytch cpfdnlsrtf yggrdcsdil lgcthqqcln ngtciphfqd gqhgfscicp
361  sgytgslcei attlsfegdg flwvksgsvt tkgsvcnial rfqtvgpmal llfrsnrdvf
421  vklellsgyi hlsiqvnnqs kvllfishnt sdgewhfvev ifaeavtltl iddsckekci
481  akaptplesd qsicafqnsf lgglpvgmts ngvallnfyn mpstpsfvgc lqdikidwnh
541  itlenissgs slnvkagcvr kdwcesqpcq srgrcinlwl syqcdchrpy egpnclreyv
601  agrfgqddst gyviftldes ygdtislsmf vrtlgpsgll lalenstyqy irvwlergrl
661  amltpnspkl vvkfvindgn vhlislkikp ykielyqssq nlgfisastw kiekgdviyi
721  gglpdkqete lnggffkgci qdvrinnqnl effpnptnna slnpvlnvt qgcagdnsck
781  snpchnggvc hsrwddfscs cpaltsgkac eevqwcgfsp cphgaqcqpv lqgfeciana
841  vfnggsgqil frsngnitre ltnitfgfrt rdanviilha ekepeflnis igdsrlffql
901  qsgnsfymls ltslqsvndg twhevtlsmt dplsqtsrwq mevdnetpfv tstiatgsln
```

TABLE 1-continued

```
 961 flkdntdiyv gdraidnikg lqgclstiei ggiylsyfen vhgfinkpqe eqflkistns
1021 vvtgclqlnv cnsnpclhgg ncediyssyh cscplgwsgk hcelnidecf snpcihgncs
1081 drvaayhctc epgytgvnce vdidncqshq cangatcish tngyscicfg nftgkfcrqs
1141 rlpstvcgne ktnitcyngg nctefqtelk cmcrpgftge wcekdideca sdpcvngglc
1201 qdllnkfqcl cdvafagerc evdladdlis difttigsvt vallllillla ivasvvtsnk
1261 ratqgtysps rqekegsrve mwnlmpppam erli
```

SEQ ID NO: 47 Human CRB1 cDNA Sequence Variant 3 (NM_001257965.1, CDS: from 340 to 4488)

```
   1 atgtgcgcgc acgccgcttt acgcatgctc cttaagttcc ccgtactccc tcggagaccc
  61 tagctacacg ccgaatccgt tactccgggt tttcgcagtg gctcggtggc ctaccccgat
 121 cgaaacctag tctggaactg aacctacaat atctctgagg aggacacat ctatgactag
 181 cagtggcatg tgctcaggaa agattccttt tgcaataaaa acaacaccag gtgcctctca
 241 aattcttgcc aaaacaattc tacatgcaaa gattttttcaa aagacaatga ttgttcttgt
 301 tcagacacag ccaataattt ggacaaagac tgtgacaaca tgaaagaccc ttgcttctcc
 361 aatccctgtc aaggaagtgc cacttgtgtg aacaccccag agaaaggag cttctgtgc
 421 aaatgtcctc ctgggtacag tgggacaatc tgtgaaacta ccattggttc ctgtggcaag
 481 aactcctgcc aacatggagg tatttgccat caggacccta tttatcctgt ctgcatctgc
 541 cctgctggat atgctggaag attctgtgag atagatcacg atgagtgtgc ttccagccct
 601 tgccaaaatg gggccgtgtg ccaggatgga attgatggtt actcctgctt ctgtgtccca
 661 ggatatcaag gcagacactg cgacttggaa gtggatgaat gtgcttcaga tccctgcaag
 721 aacgaggcta catgcctcaa tgaaatagga agatatactt gtatctgtcc ccacaattat
 781 tctggtgtaa actgtgaatt ggaaattgac gaatgttggt cccagccttg tttaaatggt
 841 gcaacttgtc aggatgctct gggggcctat ttctgcgact gtgcccctgg attcctgggg
 901 gatcactgtg aactcaacac tgatgagtgt gccagtcaac cttgtctcca tggagggctg
 961 tgtgtggatg agaaaacag atatagctgt aactgcacgg gtagtggatt cacagggaca
1021 cactgtgaga ccttgatgcc tctttgttgg tcaaaacctt gtcacaataa tgctacatgt
1081 gaggacagtg ttgacaatta cacttgtcac tgctggcctg atacacagg tgcccagtgt
1141 gagatcgacc tcaatgaatg caatagtaac ccctgccagt ccaatgggga atgtgtggag
1201 ctgtcctcag agaaacaata tggacgcatc actggactgc cttcttcttt cagctaccat
1261 gaagcctcag gttatgtctg tatctgtcag cctggattca caggaatcca ctgcgaagaa
1321 gacgtcaatg aatgttcttc aaacccttgc caaaatggtg gtacttgtga aacttgcct
1381 gggaattata cttgccattg cccatttgat aacctttcta gaactttta tggaggaagg
1441 gactgttctg atattctcct gggctgtacc catcagcaat gtctaaataa tggaacatgc
1501 atccctcact tccaagatgg ccagcatgga ttcagctgcc tgtgtccatc tggctacacc
1561 gggtccctgt gtgaaatcgc aaccacactt tcatttgagg gcgatggctt cctgtgggtc
1621 aaaagtggct cagtgacaac caagggctca gtttgtaaca tagccctcag gtttcagact
1681 gttcagccaa tggctcttct acttttccga agcaacaggg atgtgtttgt gaagctggag
1741 ctgctaagtg gctacattca cttatcaatt caggtcaata atcagtcaaa ggtgcttctg
1801 ttcatttccc acaacaccag cgatggagag tggcatttcg tggaggtaat atttgcagag
1861 gctgtgaccc ttaccttaat cgacgactcc tgtaaggaga atgcatcgc gaaagctcct
1921 actccacttg aaagtgatca atcaatatgt gcttttcaga actccttttt gggtggttta
```

TABLE 1-continued

```
1981  ccagtgggaa tgaccagcaa tggtgttgct ctgcttaact tctataatat gccatccaca
2041  ccttcgtttg taggctgtct ccaagacatt aaaattgatt ggaatcacat taccctggag
2101  aacatctcgt ctggctcatc attaaatgtc aaggcaggct gtgtgagaaa ggattggtgt
2161  gaaagccaac cttgtcaaag cagaggacgc tgcatcaact tgtggctgag ttaccagtgt
2221  gactgccaca ggccctatga aggccccaac tgtctgagag agtatgtggc aggcagattt
2281  ggccaggatg actccactgg ttatgtcatc tttactcttg atgagagcta tggagacacc
2341  atcagcctct ccatgtttgt ccgaacgctt caaccatcag gcttacttct agctttggaa
2401  aacagcactt atcaatatat ccgtgtctgg ctagagcgcg gcagactagc aatgctgact
2461  ccaaactctc ccaaattagt agtaaaattt gttcttaatg atggaaatgt ccacttgata
2521  tctttgaaaa tcaagccata taaaattgaa ctgtatcagt cttcacaaaa cctaggattt
2581  atttctgctt ctacgtggaa aatcgaaaag ggagatgtca tctacattgg tggcctacct
2641  gacaagcaag agactgaact taatggtgga ttcttcaaag gctgtatcca agatgtaaga
2701  ctaaacaacc aaaatctgga attctttcca aatccaacaa acaatgcatc tctcaatcca
2761  gttcttgtca atgtaaccca aggctgtgct ggagacaaca gctgcaagag gcagaccaat
2821  gtgggaaggg cactcactga gttgggatcc agaggaccta agtaccaagt ttcactgttt
2881  cgcttctgtg taggatcttg ggcaactgga aacaccttct ttttatcatc tataaaacca
2941  ggatccaacc cctgtcacaa tggaggtgtt tgccattccc ggtgggatga cttctcctgt
3001  tcctgtcctg ccctcacaag tgggaaagcc tgtgaggagg ttcagtggtg tggattcagc
3061  ccgtgtcctc acggagccca gtgccagccg gtgcttcaag gatttgaatg tattgcaaat
3121  gctgttttta atggacaaag cggtcaaata ttattcagaa gcaatgggaa tattaccaga
3181  gaactcacca atatcacatt tggtttcaga acaagggatg caaatgtaat aatattgcat
3241  gcagaaaaag agcctgaatt tcttaatatt agcattcaag attccagatt attctttcaa
3301  ttgcaaagtg caacagctt ttatatgcta agtctgacaa gtttgcagtc agtgaatgat
3361  ggcacatggc acgaagtgac ccttttccatg acagacccac tgtcccagac ctccaggtgg
3421  caaatggaag tggacaacga aacaccttt gtgaccagca caattgctac tggaagcctc
3481  aacttttga aggataatac agatatttat gtgggagaca gagctattga caatataaag
3541  ggcctgcaag ggtgtctaag tacaatagaa atcggaggca tttatctctc ttactttgaa
3601  aatgttcatg gtttcattaa taaacctcag gaagagcaat ttctcaaaat ctctaccaat
3661  tcagtggtca ctgctgtttt gcagttaaat gtctgcaact ccaacccctg tttgcatgga
3721  ggaaactgtg aagacatcta tagctcttat cattgctcct gtcccttggg atggtcaggg
3781  aaacactgtg aactcaacat cgatgaatgc ttttcaaacc cctgtatcca tggcaactgc
3841  tctgacagag ttgcagccta ccactgcaca tgtgagcctg gatacactgg tgtgaactgt
3901  gaagtggata tagacaactg ccagagtcac cagtgtgcaa atggagccac ctgcattagt
3961  catactaatg gctattcttg cctctgtttt ggaaattta caggaaaatt ttgcagacag
4021  agcagattac cctcaacagt ctgtgggaat gagaagacaa atctcacttg ctacaatgga
4081  ggcaactgca cagagttcca gactgaatta aaatgtatgt gccggccagg ttttactgga
4141  gaatggtgtg aaaaggacat tgatgagtgt gcctctgatc cgtgtgtcaa tggaggtctg
4201  tgccaggact tactcaacaa attccagtgc ctctgtgatg ttgcctttgc tggcgagcgc
4261  tgcgaggtgg acttggcaga tgacttgatc tccgacattt tcaccactat tggctcagtg
4321  actgtcgcct tgttactgat cctcttgctg gccattgttg cttctgttgt cacctccaac
```

TABLE 1-continued

```
4381  aaaagggcaa ctcagggaac ctacagcccc agccgtcagg agaaggaggg ctcccgagtg 4441  gaaatgtgga acttgatgcc accccctgca atggagagac tgatttagga gcattgtgtc 4501  ccttcgagat ggggatccac acactgtgaa tgtgatgact gtacttcagg tatctctgac 4561  atacctgaca atgttaatct gcaactggga ttacactgga actacaggaa tgattccttt 4621  gaccacctta aaaactttca cagtggttcc gctcgacacc attgttttat tatattatat 4681  cagccaattg caaaaaaagt ctgtgccagt aatttcagcc ttataattag caaaaacatc 4741  ttccagagaa taaagtcttc tgtggcttta gtggctatca ctgaaactct ttcctctttt 4801  caacctggga acaaatttta gttttcattt taggtttctg tactttctgt agtttctgtg 4861  taaactgcca tatgtttaca tggaaactac aggaaaaaat tggctacatt tctcacttct 4921  cctatcatgt ggtcaaagtt attgttgtat accagcgatg ggatgtatac ttttgtcctt 4981  cattcatgga ttcagagaaa gctctgggaa tgacttatgg tccaaaaaag tgacccaatg 5041  gcaacaaata aaaattgaaa tgcaaaaaaa aaaaaaaaaa aa
```

SEQ ID NO: 48 Human CRB1 Amino Acid Sequence Isoform C (NP_001244894.1)
```
   1  mkdpcfsnpc qgsatcvntp gersflckcp pgysgticet tigscgknsc qhggichqdp 61  iypvcicpag yagrfceidh decasspcqn gavcgdgidg yscfcvpgyq grhcdlevde 121  casdpcknea tclneigryt cicphnysgv nceleidecw sqpclngatc qdalgayfcd 181  capgflgdhc elntdecasq pclhgglcvd genryscnct gsgftgthce tlmplcwskp 241  chnnatceds vdnytchcwp gytgaqceid lnecnsnpcq sngecvelss ekqygritgl 301  pssfsyheas gyvcicqpgf tgihceedvn ecssnpcqng gtcenlpgny tchcpfdnls 361  rtfyggrdcs dillgcthqg clnngtciph fqdgqhgfsc lcpsgytgsl ceiattlsfe 421  gdgflwvksg svttkgsvcn ialrfqtvqp mallllfrsnr dvfvklells gyihlsiqvn 481  ngskvllfis hntsdgewhf vevifaeavt ltliddscke kciakaptpl esdqsicafq 541  nsflgglpvg mtsngvalln fynmpstpsf vgclqdikid wnhitlenis sgsslnvkag 601  cvrkdwcesq pcqsrgrcin lwlsyqcdch rpyegpnclr eyvagrfgqd dstgyviftl 661  desygdtisl smfvrtlqps glllalenst yqyirvwler grlamltpns pklvvkfvin 721  dgnvhlislk ikpykielyq ssqnlgfisa stwkiekgdv iyigglpdkq etelnggffk 781  gciqdvrinn qnleffpnpt nnaslnpvlv nvtqgcagdn sckrqtnvgr altelgsrgp 841  kyqvslfrfc vgswatgntf flssikpgsn pchnggvchs rwddfscscp altsgkacee 901  vqwcgfspcp hgaqcqpvlq gfecianavf nggsgqilfr sngnitrelt nitfgfrtrd 961  anviilhaek epeflnisiq dsrlffqlqs gnsfymlslt slqsvndgtw hevtlsmtdp 1021  lsqtsrwqme vdnetpfvts tiatgslnfl kdntdiyvgd raidnikglq gclstieigg 1081  iylsyfenvh gfinkpqeeq flkistnsvv tgclqlnvcn snpclhggnc ediyssyhcs 1141  cplgwsgkhc elnidecfsn pcihgncsdr vaayhctcep gytgvncevd idncgshgca 1201  ngatcishtn gyscicfgnf tgkfcrqsrl pstvcgnekt nitcynggnc tefqtelkcm 1261  crpgftgewc ekdidecasd pcvngglcqd llnkfqcicd vafagercev dladdlisdi 1321  fttigsvtva lllilllaiv asvvtsnkra tqgtyspsrq ekegsrvemw nlmpppamer 1381  li
```

SEQ ID NO: 49 Human CRB1 cDNA Sequence Variant 4 (NM_001257966.1, CDS: from 210 to 2822)
```
   1  cctcccgtgt aagtgatgct aagaagcaca aactgcattt tgaatctaag tccctgtatt 61  ttctgtgaag gagctgtaag tagggtggga cagagatggc acctggggt tctgaggcac 21  ccgctcctct ctgagacaga cagggatcag gagccggact gggaccagac caccagcaac
```

TABLE 1-continued

```
 181  acaccagagg atgttctcta aataagacca tggcacttaa gaacattaac taccttctca
 241  tcttctacct cagtttctca ctgcttatct acataaaaaa ttccttttgc aataaaaaca
 301  acaccaggtg cctctcaaat tcttgccaaa acaattctac atgcaaagat ttttcaaaag
 361  acaatgattg ttcttgttca gacacagcca ataatttgga caaagactgt gacaacatga
 421  aagacccttg cttctccaat ccctgtcaag gaagtgccac ttgtgtgaac accccaggag
 481  aaaggagctt tctgtgcaaa tgtcctcctg ggtacagtgg acaatctgt gaaactacca
 541  ttggttcctg tggcaagaac tcctgccaac atggaggtat tgccatcag acccctattt
 601  atcctgtctg catctgccct gctggatatg ctggaagatt ctgtgagata gatcacgatg
 661  agtgtgcttc cagcccttgc caaaatgggg ccgtgtgcca ggatggaatt gatggttact
 721  cctgcttctg tgtcccagga tatcaaggca gacactgcga cttggaagtg atgaatgtg
 781  cttcagatcc ctgcaagaac gaggctacat gcctcaatga aataggaaga tatacttgta
 841  tctgtcccca caattattct ggtgtaaact gtgaattgga aattgacgaa tgttggtccc
 901  agccttgttt aaatggtgca acttgtcagg atgctctggg ggcctatttc tgcgactgtg
 961  cccctggatt cctggggat cactgtgaac tcaacactga tgagtgtgcc agtcaacctt
1021  gtctccatgg agggctgtgt gtggatggag aaaacagata tagctgtaac tgcacgggta
1081  gtggattcac agggacacac tgtgagacct tgatgcctct tgttggtca aaaccttgtc
1141  acaataatgc tacatgtgag gacagtgttg acaattacac ttgtcactgc tggcctggat
1201  acacaggtgc ccagtgtgag atcgacctca tgaatgcaa tagtaacccc tgccagtcca
1261  atggggaatg tgtggagctg tcctcagaga acaatatgg acgcatcact ggactgcctt
1321  cttctttcag ctaccatgaa gcctcaggtt atgtctgtat ctgtcagcct ggattcacag
1381  gaatccactg cgaagaagac gtcaatgaat gttcttcaaa cccttgccaa aatggtggta
1441  cttgtgagaa cttgcctggg aattatactt gccattgccc atttgataac ctttctagaa
1501  cttttatgg aggaagggac tgttctgata ttctcctggg ctgtacccat cagcaatgtc
1561  taaataatgg aacatgcatc cctcacttcc aagatggcca gcatggattc agctgcctgt
1621  gtccatctgg ctacaccggg tccctgtgtg aaatcgcaac cacactttca tttgagggcg
1681  atggcttcct gtgggtcaaa agtggctcag tgacaaccaa gggctcagtt tgtaacatag
1741  ccctcaggtt tcagactgtt cagccaatgg ctcttctact tttccgaagc aacagggatg
1801  tgtttgtgaa gctggagctg ctaagtggct acattcactt atcaattcag gtcaataatc
1861  agtcaaaggt gcttctgttc atttcccaca acaccagcga tggagagtgg catttcgtgg
1921  aggtaatatt tgcagaggct gtgacccta ccttaatcga cgactcctgt aaggagaaat
1981  gcatcgcgaa agctcctact ccacttgaaa gtgatcaatc aatatgtgct tttcagaact
2041  ccttttggg tggtttacca gtgggaatga ccagcaatgg tgttgctctg cttaacttct
2101  ataatatgcc atccacacct tcgtttgtag gctgtctcca agacattaaa attgattgga
2161  atcacattac cctggagaac atctcgtctg gctcatcatt aaatgtcaag gcaggctgtg
2221  tgagaaagga ttggtgtgaa agccaaccct tgtcaaagca aggacgctgc atcaacttgt
2281  ggctgagtta ccagtgtgac tgccacaggc cctatgaagg ccccaactgt ctgagaggaa
2341  aattttgcag acagagcaga ttaccctcaa cagtctgtgg aatgagaag acaaatctca
2401  cttgctacaa tggaggcaac tgcacagagt tccagactga attaaaatgt atgtgccggc
2461  caggttttac tggagaatgg tgtgaaaagg acattgatga gtgtgcctct gatccgtgtg
2521  tcaatggagg tctgtgccag gacttactca acaaaattcc gtgcctctgt gatgttgcct
```

TABLE 1-continued

```
2581  ttgctggcga gcgctgcgag gtggacttgg cagatgactt gatctccgac attttcacca 2641  ctattggctc agtgactgtc gccttgttac tgatcctctt gctggccatt gttgcttctg 2701  ttgtcacctc aacaaaagg gcaactcagg gaacctacag ccccagccgt caggagaagg 2761  agggctcccg agtggaaatg tggaacttga tgccacccccc tgcaatggag agactgattt 2821  aggagcattg tgtcccttcg agatggggat ccacacactg tgaatgtgat gactgtactt 2881  caggtatctc tgacatacct gacaatgtta atctgcaact gggattacac tggaactaca 2941  ggaatgattc cttctgaccac cttaaaaact ttcacagtgg ttccgctcga caccattgtt 3001  ttattatatt atatcagcca attgcaaaaa aagtctgtgc cagtaatttc agccttataa 3061  ttagcaaaaa catcttccag agaataaagt cttctgtggc tttagtggct atcactgaaa 3121  ctctttcctc ttttcaacct gggaacaaat tttagttttc attttaggtt tctgtacttt 3181  ctgtagtttc tgtgtaaact gccatatgtt tacatggaaa ctacaggaaa aaattggcta 3241  catttctcac ttctcctatc atgtggtcaa agttattgtt gtataccagc gatgggatgt 3301  atacttttgt ccttcattca tggattcaga gaaagctctg ggaatgactt atggtccaaa 3361  aaagtgaccc aatggcaaca ataaaaatt gaaatgcaaa aaaaaaaaaa aaaaaa
```

SEQ ID NO: 50 Human CRB1 Amino Acid Sequence Isoform D (NP_001244895.1)
```
    1  malkninyll ifylsfslli yiknsfcnkn ntrclsnscq nnstckdfsk dndcscsdta
   61  nnldkdcdnm kdpcfsnpcq gsatcvntpg ersflckcpp gysgticett igscgknscq
  121  hggichqdpi ypvcicpagy agrfceidhd ecasspcqng avcgdgidgy scfcvpgyqg
  181  rhcdlevdec asdpckneat clneigrytc icphnysgvn celeidecws qpclngatcq
  241  dalgayfcdc apgflgdhce lntdecasqp clhgglcvdg enryscnctg sgftgthcet
  301  lmplcwskpc hnnatcedsv dnytchcwpg ytgagceidl necnsnpcqs ngecvelsse
  361  kqygritglp ssfsyheasg yvcicqpgft gihceedvne cssnpcqngg tcenlpgnyt
  421  chcpfdnlsr tfyggrdcsd illgcthqqc lnngtciphf qdgqhgfscl cpsgytgslc
  481  eiattlsfeg dgflwvksgs vttkgsvcni alrfqtvgpm alllfrsnrd vfvklellsg
  541  yihlsiqvnn qskvllfish ntsdgewhfv evifaeavtl tliddsckek ciakaptple
  601  sdqsicafqn sflgglpvgm tsngvallnf ynmpstpsfv gclqdikidw nhitleniss
  661  gsslnvkagc vrkdwcesqp cgsrgrcinl wlsyqcdchr pyegpnclrg kfcrqsrlps
  721  tvcgnektnl tcynggncte fqtelkcmcr pgftgewcek didecasdpc vngglcqdll
  781  nkfqcicdva fagercevdl addlisdift tigsvtvall lillaivas vvtsnkratq
  841  gtyspsrqek egsrvemwnl mpppamerli
```

SEQ ID NO: 51 Mouse CRB1 cDNA Sequence (NM_133239.2, CDS: from 167 to 4384)
```
    1  gaagtgcttt ctgattctct gtctgtggag gagccctggg aggggtggga cagagatggc
   61  atcctggctc tctgaggcac ctgctcttct ctgaaccaca caggagtcaa gagccaaaca
  121  gggatagctt cagcagcact tcagagggtg ttctctaagt aagaacatga agctcaagag
  181  aactgcctac cttctcttcc tgtacctcag ctcctcactg ctcatctgca taaagaattc
  241  attttgcaat aaaaacaata ccaggtgcct tcaggtcct tgccaaaaca attctacgtg
  301  caagcatttt ccacaagaca acaattgttg cttagacaca gccataatt tggacaaaga
  361  ctgtgaagat ctgaaagacc cttgcttctc gagtccctgc aaggaattg ccacttgtgt
  421  gaaaatccca ggggaaggga acttcctgtg tcagtgtcct cctgggtaca gcgggctgaa
  481  ctgtgaaact gccaccaatt cctgtggagg gaacctctgc caacatggag gcacctgccg
```

TABLE 1-continued

```
 541  taaagaccct gagcaccctg tctgtatctg ccctcctgga tatgctggaa ggttctgtga
 601  gactgatcac aatgagtgtg cttctagccc ttgccacaat ggggctatgt gccaggatgg
 661  aatcaatggc tactcctgct tctgtgtgcc tggataccaa ggcaggcatt gtgacttgga
 721  agtggatgaa tgtgtttctg atccctgcaa gaatgaggct gtgtgcctca atgagatagg
 781  aagatacact tgtgtctgcc ctcaagagtt ttctggcgtg aactgtgagt tggaaattga
 841  tgaatgcaga tcccagcctt gtctccacgg tgccacatgt caggacgctc aggggggcta
 901  ctcctgtgac tgtgcacctg gattccttgg agagcactgt gaactcagcg ttaatgaatg
 961  tgaaagtcag ccgtgtctcc atggaggtct atgtgtggat ggaagaaaca gttaccactg
1021  tgactgcaca ggtagtggat tcacagggat gcactgtgag tccttgattc ctctttgttg
1081  gtcaaagcct tgtcacaacg acgcgacatg tgaagatact gttgacagct atatttgtca
1141  ctgccggcct ggatacacag gtgccctgtg tgagacagac ataaatgaat gcagtagcaa
1201  cccctgccaa ttttgggggg aatgtgtcga gctgtcctca gagggtctat atggaaacac
1261  tgctggcctg ccttcctcct tcagctatgt tggagcctcg gctatgtgt gtatctgtca
1321  gcctggattc acaggaattc actgtgaaga gacgttgat gaatgtttac tgcaccccttg
1381  cctaaatggt ggtacttgtg agaacctgcc tgggaattat gcctgtcact gtccctttga
1441  tgacacttct aggacatttt atggaggaga aaactgctca gaaattctcc tgggctgcac
1501  tcatcaccag tgtctgaaca atggaaaatg tatccctcat ttccaaaatg gccagcatgg
1561  attcacttgc cagtgtcttt ctggctatgc ggggcccctg tgtgaaactg tcaccacact
1621  ttcatttggg agcaatggct cctatgggt cacaagtggc tcccatacag gcatagggcc
1681  agaatgtaac atatccttga ggtttcacac tgttcaacca acgcacttc tcctcatccg
1741  aggcaacaag gacgtgtcta tgaagctgga gttgctgaat ggttgtgttc acttatcaat
1801  tgaagtctgg aatcagttaa aggtgctcct gtctatttct cacaacacca gtgatggaga
1861  atggcatttc gtggaggtaa caatcgcaga aactctaacc cttgccctag ttggcggctc
1921  ctgcaaggag aagtgcacca ccaagtcttc tgttccagtt gagaatcatc aatcaatatg
1981  tgcttttgcag gactcttttt tgggtggctt accaatgggg acagccaaca acagtgtgtc
2041  tgtgcttaac atctataatg tgccgtccac accttccttt gtaggctgtc tccaagacat
2101  tagatttgat ttgaatcaca ttactctgga gaacgtttca tctggcctgt catcaaatgt
2161  taaagcaggc tgcctgggaa aggactggtg tgaaagtcaa ccctgtcaaa acagaggacg
2221  ctgcatcaac ttgtggcagg gttatcagtg tgaatgtgac aggccctata caggctccaa
2281  ctgcctgaaa gagtatgtag cgggaagatt tggccaagat gactccacag gatatgcggc
2341  ctttagtgtt aatgataatt atggacagaa cttcagtctt tcaatgtttg tccgaacacg
2401  tcaacccctg ggcttacttc tggctttgga aaatagtact taccagtatg tcagtgtctg
2461  gctagagcac ggcagcctag cactgcagac tccaggctct cccaagttca tggtaaactt
2521  tttctcagt gatggaaatg ttcacttaat atctttgaga atcaaaccaa atgaaattga
2581  actgtatcag tcttcacaaa acctaggatt catttctgtt cctacatgga caattcgaag
2641  aggagacgtc atcttcattg gtggcttacc tgcagagag aagactgaag tttatggtgg
2701  cttcttcaaa ggctgtgttc aagatgtcag attaaacagc cagactctgg aattctttcc
2761  caattcaaca aacaatgcat acgatgaccc aattcttgtc aatgtgactc aaggctgtcc
2821  cggagacaac acatgtaagt ccaacccctg tcataatgga ggtgtctgcc actccctgtg
2881  ggatgacttc tcctgctcct gccctacaaa cacagcgggg agagcctgcg agcaagttca
```

TABLE 1-continued

```
2941  gtggtgtcaa ctcagcccat gtcctcccac tgcagagtgc cagctgctcc ctcaagggtt
3001  tgaatgtatc gcaaacgctg ttttcagcgg attaagcaga gaaatactct tcagaagcaa
3061  tgggaacatt accagagaac tcaccaatat cacatttgct ttcagaacac atgatacaaa
3121  tgtgatgata ttgcatgcag aaaaagaacc agagtttctt aatattagca ttcaagatgc
3181  cagattattc tttcaattgc gaagtggcaa cagcttttat acgctgcacc tgatgggttc
3241  ccaattggtg aatgatggca catggcacca agtgactttc tccatgatag acccagtggc
3301  ccagacctcc cggtggcaaa tggaggtgaa cgaccagaca cccttgtga taagtgaagt
3361  tgctactgga agcctgaact ttttgaagga caatacagac atctatgtgg gtgaccaatc
3421  tgttgacaat ccgaaaggcc tgcagggctg tctgagcaca atagagattg gaggcatata
3481  tctttcttac tttgaaaatc tacatggttt ccctggtaag cctcaggaag agcaatttct
3541  caaagtttct acaaatatgg tacttactgg ctgtttgcca tcaaatgcct gccactccag
3601  cccctgtttg catggaggaa actgtgaaga cagctacagt tcttatcggt gtgcctgtct
3661  ctcgggatgg tcagggacac actgtgaaat caacattgat gagtgctttt ctagcccctg
3721  tatccatggc aactgctctg atggagttgc agcctaccac tgcaggtgtg agcctggata
3781  caccggtgtg aactgtgagg tggatgtaga caattgcaag agtcatcagt gtgcaaatgg
3841  ggccacctgt gttcctgaag ctcatggcta ctcttgtctc tgctttggaa attttaccgg
3901  gagattttgc agacacagca gattaccctc aacagtctgt gggaatgaga agagaaactt
3961  cacttgctac aatggaggca gctgctccat gttccaggag gactggcaat gtatgtgctg
4021  gccaggtttc actggagagt ggtgtgaaga ggacatcaac gagtgtgcct ccgatccctg
4081  catcaatgga ggactgtgca gggacttggt caacaggttc ctatgcatct gtgatgtggc
4141  cttcgctggc gagcgctgtg agctggacct ggctgatgac aggctcctgg gcatttttcac
4201  cgctgttggc tccggaactt tggccctgtt cttcatcctc ttgcttgctg gggttgcttc
4261  tcttattgcc tccaacaaaa gggcgactca aggaacctac agccccagcg gtcaggagaa
4321  ggctggccct cgagtggaaa tgtggatcag gatgccgccc ccggcactga aaaggctcat
4381  ctaggagact gctgctcttc tcaggacaga gaagaacatg atgagtaccg ggtcgtgcct
4441  gagtgaagat ggctttacat cactagagat acatacagct gggactgtgg aaggaccttt
4501  cctgtggagt cactgagtag ttatgtcatc cattcacaga agagtgtccc tgtgtttgcc
4561  tgtcagcctc agaattagca aacatctag cagacagaga acacagtatt tcagaagaac
4621  tccagaggct gccccttaaa ctctttactg gttgatccac ataaaatgct tagtagccaa
4681  gtgccattaa ttatacagag cc
```

SEQ ID NO: 52 Mouse CRB1 Amino Acid Sequence (NP_573502.2)

```
  1  mklkrtayll flylssslli ciknsfcnkn ntrclsgpcq nnstckhfpq dnnccldtan
 61  nldkdcedlk dpcfsspcqg iatcvkipge gnflcqcppg ysglncetat nscggnlcqh
121  ggtcrkdpeh pvcicppgya grfcetdhne casspchnga mcqdgingys cfcvpgyqgr
181  hcdlevdecv sdpckneavc lneigrytcv cpqefsgvnc eleidecrsq pclhgatcqd
241  apggyscdca pgflgehcel svnecesqpc lhgglcvdgr nsyhcdctgs gftgmhcesl
301  iplcwskpch ndatcedtvd syichcrpgy tgalcetdin ecssnpcqfw gecvelsseg
361  lygntaglps sfsyvgasgy vcicqpgftg ihceedvdec llhpclnggt cenlpgnyac
421  hcpfddtsrt fyggencsei llgcthhgcl nngkciphfq ngqhgftcqc lsgyagplce
481  tvttlsfgsn gflwvtsgsh tgigpecnis lrfhtvqpna lllirgnkdv smklellngc
541  vhlsievwnq lkvllsishn tsdgewhfve vtiaetltla lvggsckekc ttkssvpven
```

TABLE 1-continued

```
 601  hqsicalqds flgglpmgta nnsysviniy nvpstpsfvg clqdirfdln hitlenvssg
 661  lssnvkagcl gkdwcesqpc qnrgrcinlw qgyqcecdrp ytgsnclkey vagrfgqdds
 721  tgyaafsvnd nygqnfslsm fvrtrqplgl llalenstyq yvsvwlehgs lalqtpgspk
 781  fmvnfflsdg nvhlislrik pneielyqss qnlgfisvpt wtirrgdvif igglpdrekt
 841  evyggffkgc vqdvrinsgt leffpnstnn ayddpilvnv tqgcpgdntc ksnpchnggv
 901  chslwddfsc scptntagra ceqvqwcqls pcpptaecql lpqgfecian avfsglsrei
 961  lfrsngnitr eltnitfafr thdtnvmilh aekepeflni siqdarlffq lrsgnsfytl
1021  hlmgsqlvnd gtwhqvtfsm idpvaqtsrw qmevndqtpf visevatgsl nflkdntdiy
1081  vgdqsvdnpk glqgclstie iggiylsyfe nlhgfpgkpq eeqflkvstn mvltgclpsn
1141  achsspclhg gncedsyssy rcaclsgwsg thceinidec fsspcihgnc sdgvaayhcr
1201  cepgytgvnc evdvdncksh qcangatcvp eahgyscicf gnftgrfcrh srlpstvcgn
1261  ekrnftcyng gscsmfqedw qcmcwpgftg ewceedinec asdpcinggl crdlvnrflc
1321  icdvafager celdladdrl lgiftavgsg tlalffilll agvasliasn kratqgtysp
1381  sgqekagpry emwirmpppa lerli
```

SEQ ID NO: 53 Human BRG1 cDNA Sequence Variant 1 (NM_001128849.1, CDS: from 75 to 5114)

```
   1  ggcggggggag cgccgggaa gtcgacggcg ccggcggctc ctgcaggagg ccactgtctg
  61  cagctcccgt gaagatgtcc actccagacc caccctgggg cggaactcct cggccaggtc
 121  cttccccggg ccctggccct tccctggag ccatgctggg ccctagcccg gtccctcgc
 181  cgggctccgc ccacagcatg atggggccca gcagggcc gccctcagca ggacacccca
 241  tccccaccca ggggcctgga gggtaccctc aggacaacat gcaccagatg cacaagccca
 301  tggagtccat gcatgagaag gcatgtcgg acgacccgcg ctacaaccag atgaaaggaa
 361  tggggatgcg gtcagggggc catgctggga tggggccccc gcccagcccc atggaccagc
 421  actcccaagg ttaccccctcg cccctgggtg gctctgagca tgcctctagt ccagttccag
 481  ccagtggccc gtcttcgggg cccagatgt cttccgggcc aggaggtgcc ccgctggatg
 541  gtgctgaccc ccaggccttg ggcagcaga accggggccc aaccccattt aaccagaacc
 601  agctgcacca gctcagagct cagatcatgg cctacaagat gctggccagg ggcagccccc
 661  tccccgacca cctgcagatg gcggtgcagg gcaagcggcc gatgcccggg atgcagcagc
 721  agatgccaac gctacctcca ccctcggtgt ccgcaacagg acccggccct ggccctggcc
 781  ctggccccgg cccgggtccc ggccggcac ctccaaatta cagcaggcct catggtatgg
 841  gagggcccaa catgcctccc caggaccct cgggcgtgcc ccccgggatg ccaggccagc
 901  ctcctggagg gcctcccaag ccctggcctg aaggacccat ggcgaatgct gctgccccca
 961  cgagcacccc tcagaagctg attccccgc agccaacggg ccgcccttcc ccgcgccc
1021  ctgccgtccc acccgccgcc tcgcccgtga tgccaccgca gacccagtcc cccgggcagc
1081  cggcccagcc cgcgcccatg gtgccactgc accagaagca gagccgcatc accccccatcc
1141  agaagccgcg gggcctcgac cctgtggaga tcctgcagga gcgcgagtac aggctgcagg
1201  ctcgcatcgc acaccgaatt caggaacttg aaaaccttcc cgggtccctg gccggggatt
1261  tgcgaaccaa agcgaccatt gagctcaagg ccctcaggct gctgaacttc agaggcagc
1321  tgcgccagga ggtggtggtg tgcatgcgga gggacacagc gctggagaca gccctcaatg
1381  ctaaggccta caagcgcagc aagcgccagt ccctgcgcga ggcccgcatc actgagaagc
1441  tggagaagca gcagaagatc gagcaggagc gcaagcgccg gcagaagcac caggaatacc
```

TABLE 1-continued

```
1501  tcaatagcat tctccagcat gccaaggatt tcaaggaata tcacagatcc gtcacaggca
1561  aaatccagaa gctgaccaag gcagtggcca cgtaccatgc caacacggag cgggagcaga
1621  agaaagagaa cgagcggatc gagaaggagc gcatgcggag gctcatggct gaagatgagg
1681  aggggtaccg caagctcatc gaccagaaga aggacaagcg cctggcctac ctcttgcagc
1741  agacagacga gtacgtggct aacctcacgg agctggtgcg gcagcacaag gctgcccagg
1801  tcgccaagga gaaaagaag aaaagaaaa agaagaaggc agaaaatgca gaaggacaga
1861  cgcctgccat tgggccggat ggcgagcctc tggacgagac cagccagatg agcgacctcc
1921  cggtgaaggt gatccacgtg gagagtggga agatcctcac aggcacagat gcccccaaag
1981  ccgggcagct ggaggcctgg ctcgagatga acccggggta tgaagtagct ccgaggtctg
2041  atagtgaaga aagtggctca agaagagagg aagaggagga ggaggaagag cagccgcagg
2101  cagcacagcc tcccaccctg cccgtggagg agaagaagaa gattccagat ccagacagcg
2161  atgacgtctc tgaggtggac gcgcggcaca tcattgagaa tgccaagcaa gatgtcgatg
2221  atgaatatgg cgtgtcccag gcccttgcac gtggcctgca gtcctactat gccgtggccc
2281  atgctgtcac tgagagagtg gacaagcagt cagcgcttat ggtcaatggt gtcctcaaac
2341  agtaccagat caaaggtttg gagtggctgg tgtccctgta caacaacaac ctgaacggca
2401  tcctggccga cgagatgggc ctggggaaga ccatccagac catcgcgctc atcacgtacc
2461  tcatggagca caaacgcatc aatgggccct tcctcatcat cgtgcctctc tcaacgctgt
2521  ccaactgggc gtacgagttt gacaagtggg cccctccgt ggtgaaggtg tcttacaagg
2581  gatccccagc agcaagacgg gcctttgtcc cccagctccg gagtgggaag ttcaacgtct
2641  tgctgacgac gtacgagtac atcatcaaag acaagcacat cctcgccaag atccgttgga
2701  agtacatgat tgtggacgaa ggtcaccgca tgaagaacca ccactgcaag ctgacgcagg
2761  tgctcaacac gcactatgtg gcaccccgcc gctgctgct gacgggcaca ccgctgcaga
2821  acaagcttcc cgagctctgg gcgctgctca acttcctgct gcccaccatc ttcaagagct
2881  gcagcacctt cgagcagtgg ttttaacgcac cctttgccat gaccggggaa aaggtggacc
2941  tgaatgagga ggaaaccatt ctcatcatcc ggcgtctcca caaagtgctg cggcccttct
3001  tgctccgacg actcaagaag gaagtcgagg cccagttgcc cgaaaaggtg gagtacgtca
3061  tcaagtgcga catgtctgcg ctgcagcgag tgctctaccg ccacatgcag gccaagggcg
3121  tgctgctgac tgatggctcc gagaaggaca agaagggcaa aggcggcacc aagaccctga
3181  tgaacaccat catgcagctg cggaagatct gcaaccaccc ctacatgttc agcacatcg
3241  aggagtcctt ttccgagcac ttggggttca ctggcggcat tgtccaaggg ctggacctgt
3301  accgagcctc gggtaaattt gagcttcttg atagaattct tcccaaactc cgagcaacca
3361  accacaaagt gctgctgttc tgccaaatga cctccctcat gaccatcatg gaagattact
3421  ttgcgtatcg cggctttaaa taccctcaggc ttgatggaac cacgaaggcg gaggaccggg
3481  gcatgctgct gaaaaccttc aacgagcccg gctctgagta cttcatcttc ctgctcagca
3541  cccgggctgg gggctcggc ctgaacctcc agtcggcaga cactgtgatc attttttgaca
3601  gcgactggaa tcctcaccag gacctgcaag cgcaggaccg agcccaccgc atcgggcagc
3661  agaacgaggt gcgtgtgctc cgcctctgca ccgtcaacag cgtggaggag aagatcctag
3721  ctgcagccaa gtacaagctc aacgtggacc agaaggtgat ccaggccggc atgttcgacc
3781  agaagtcctc cagccatgag cggcgcgcct tcctgcaggc catcctggag cacgaggagc
3841  aggatgagag cagacactgc agcacgggca gcggcagtgc cagcttcgcc cacactgccc
```

```
3901  ctccgccagc gggcgtcaac ccgacttgg aggagccacc tctaaaggag aagacgagg
3961  tgcccgacga cgagaccgtc aaccagatga tcgcccggca cgaggaggag tttgatctgt
4021  tcatgcgcat ggacctggac cgcaggcgcg aggaggcccg caaccccaag cggaagccgc
4081  gcctcatgga ggaggacgag ctcccctcgt ggatcatcaa ggacgacgcg gaggtggagc
4141  ggctgacctg tgaggaggag gaggagaaga tgttcggccg tggctcccgc caccgcaagg
4201  aggtggacta cagcgactca ctgacggaga agcagtggct caagaaaatt acaggaaaag
4261  atatccatga cacagccagc agtgtggcac gtgggctaca attccagcgt ggccttcagt
4321  tctgcacacg tgcgtcaaag gccatcgagg agggcacgct ggaggagatc aagaggagg
4381  tccggcagaa gaaatcatca cggaagcgca agcgagacag cgacgccggc tcctccaccc
4441  cgaccaccag cacccgcagc cgcgacaagg acgacgagag caagaagcag aagaagcgcg
4501  ggcggccgcc tgccgagaaa ctctccccta acccacccaa cctcaccaag aagatgaaga
4561  agattgtgga tgccgtgatc aagtacaagg acagcagcag tggacgtcag ctcagcgagg
4621  tcttcatcca gctgccctcg cgaaaggagc tgcccgagta ctacgagctc atccgcaagc
4681  ccgtggactt caagaagata aaggagcgca tcgcaaccaa caagtaccgc agcctcaacg
4741  acctagagaa ggacgtcatg ctcctgtgcc agaacgcaca gaccttcaac ctggagggct
4801  ccctgatcta tgaagactcc atcgtcttgc agtcggtctt caccagcgtg cggcagaaaa
4861  tcgagaagga ggatgacagt gaaggcgagg agagtgagga ggaggaagag ggcgaggagg
4921  aaggctccga atccgaatct cggtccgtca agtgaagat caagcttggc cggaaggaga
4981  aggcacagga ccggctgaag ggcggccggc ggcggccgag ccgagggtcc cgagccaagc
5041  cggtcgtgag tgacgatgac agtgaggagg aacaagagga ggaccgctca ggaagtggca
5101  gcgaagaaga ctgagccccg acattccagt ctcgaccccg agcccctcgt tccagagctg
5161  agatggcata ggccttagca gtaacgggta gcagcagatg tagttttcaga cttggagtaa
5221  aactgtataa acaaaagaat cttccatatt tatacagcag agaagctgta ggactgtttg
5281  tgactggccc tgtcctggca tcagtagcat ctgtaacagc attaactgtc ttaaagagag
5341  agagagagaa ttccgaattg gggaacacac gatacctgtt tttcttttcc gttgctggca
5401  gtactgttgc gccgcagttt ggagtcactg tagttaagtg tggatgcatg tgcgtcaccg
5461  tccactcctc ctactgtatt ttattggaca ggtcagactc gccggggggcc cggcgagggt
5521  atgtcagtgt cactggatgt caaacagtaa taaattaaac caacaacaaa acgcacagcc
5581  aaaaaaaaa
```

SEQ ID NO: 54 Human BRG1 Amino Acid Sequence Isoform A (NP_001122321.1, CDS: from 75 to 5114)

```
  1  mstpdpplgg tprpgpspgp gpspgamlgp spgpspgsah smmgpspgpp saghpiptqg
 61  pggypqdnmh qmhkpmesmh ekgmsddpry nqmkgmgmrs gghagmgppp spmdqhsqgy
121  psplggseha sspvpasgps sgpqmssgpg gapldgadpq algqqnrgpt pfnqnqlhql
181  ragimaykml argqplpdhl qmavqgkrpm pgmqqqmptl pppsysatgp gpgpgpgpgp
241  gpgpappnys rphgmggpnm pppgpsgvpp gmpgqppggp pkpwpegpma naaaptstpq
301  klippqptgr pspappavpp aaspvmppqt gspggpagpa pmvplhqkqs ritpiqkprg
361  ldpveilger eyrlgariah rigelenlpg slagdlrtka tielkalrll nfqrqlrgev
421  vvcmrrdtal etalnakayk rskrqslrea riteklekqg kiegerkrrq khqeylnsil
481  qhakdfkeyh rsvtgkiqkl tkavatyhan tereqkkene riekermrrl maedeegyrk
541  lidqkkdkrl ayllqqtdey vanitelvrq hkaaqvakek kkkkkkkae naegqtpaig
```

TABLE 1-continued

```
 601  pdgepldets qmsdlpvkvi hvesgkiltg tdapkagqle awlemnpgye vaprsdsees
 661  gseeeeeeee eeqpqaaqpp tlpveekkki pdpdsddvse vdarhiiena kqdvddeygv
 721  sgalarglqs yyavahavte rvdkqsalmv ngvlkqyqik glewlvslyn nnlngilade
 781  mglgktiqti alitylmehk ringpfliiv plstlsnway efdkwapsvv kvsykgspaa
 841  rrafvpqlrs gkfnvlltty eyiikdkhil akirwkymiv deghrmknhh ckltqvinth
 901  yvaprrlllt gtplqnklpe lwallnfllp tifkscstfe qwfnapfamt gekvdlneee
 961  tiliirrlhk vlrpfllrrl kkeveaqlpe kveyvikcdm salqrvlyrh mqakgvlltd
1021  gsekdkkgkg gtktlmntim qlrkicnhpy mfqhieeesfs ehlgftggiv qgldlyrasg
1081  kfelldrilp klratnhkvl lfcgmtslmt imedyfayrg fkylrldgtt kaedrgmllk
1141  tfnepgseyf ifllstragg lglnlqsadt viifdsdwnp hqdlqaqdra hrigqgnevr
1201  vlrlctvnsv eekilaaaky klnvdqkviq agmfdqksss herraflqai leheeqdesr
1261  hcstgsgsas fahtapppag vnpdleeppl keedevpdde tvnqmiarhe eefdlfmrmd
1321  ldrrreearn pkrkprlmee delpswiikd daeverltce eeeekmfgrg srhrkevdys
1381  dsltekqwlk kitgkdihdt assvarglqf qrglqfctra skaieegtle eieeevrqkk
1441  ssrkrkrdsd agsstpttst rsrdkddesk kqkkrgrppa eklspnpppnl tkkmkkivda
1501  vikykdsssg rqlsevfiql psrkelpeyy elirkpvdfk kikerirnhk yrslndlekd
1561  vmllcgnagt fnlegsliye dsivlqsvft svrqkieked dsegeeseee eegeeegses
1621  esrsvkvkik lgrkekaqdr lkggrrrpsr gsrakpvvsd ddseeeqeed rsgsgseed SEQ ID NO: 55 Human BRG1 cDNA Sequence Variant 2 (NM_001128844.1, CDS:
from 361 to 5304)
   1  ggagaggccg ccgcggtgct gaggggggagg ggagccggcg agcgcgcgcg cagcgggggc
  61  gcgggtggcg cgcgtgtgtg tgaagggggg gcggtggccg aggcgggcgg gcgcgcgcgc
 121  gaggcttccc ctcgtttggc ggcggcggcg gcttctttgt ttcgtgaaga gaagcgagac
 181  gcccattctg ccccccggcc cgcgcggagg ggcgggggag gcgccgggaa gtcgacggcg
 241  ccggcggctc ctgcgtctcg cccttttgcc caggctagag tgcagtggtg cggtcatggt
 301  tcactgcagc ctcaacctcc tggactcagc aggaggccac tgtctgcagc tcccgtgaag
 361  atgtccactc cagacccacc cctgggcgga actcctcggc caggtccttc cccgggccct
 421  ggcccttccc ctggagccat gctgggccct agcccgggtc cctcgccggg ctccgcccac
 481  agcatgatgg ggcccagccc agggccgccc tcagcaggac accccatccc cacccagggg
 541  cctggagggt accctcagga caacatgcac cagatgcaca agccatgga gtccatgcat
 601  gagaagggca tgtcggacga cccgcgctac aaccagatga aggaatggg gatgcggtca
 661  gggggccatg ctgggatggg gcccccgccc agcccatgg accagcactc ccaaggttac
 721  ccctcgcccc tgggtggctc tgagcatgcc tctagtccag ttccagccag tggcccgtct
 781  tcggggcccc agatgtcttc cgggccagga ggtgccccgc tggatggtgc tgaccccccag
 841  gccttggggc agcagaaccg gggcccaacc ccatttaacc agaaccagct gcaccagctc
 901  agagctcaga tcatggccta caagatgctg gccaggggc agcccctccc cgaccacctg
 961  cagatggcgg tgcagggcaa gcggccgatg cccgggatgc agcagcagat gcaacgcta
1021  cctccaccct cggtgtccgc aacaggaccc ggcctggcc tggccctgg ccccggcccg
1081  ggtccggcc cggcacctcc aaattacagc aggcctcatg gtatgggagg gcccaacatg
1141  cctccccag acccctcggg cgtgcccccc gggatgccag gccagcctcc tggagggcct
1201  cccaagccct ggcctgaagg acccatggcg aatgctgctg cccccacgag caccccctcag
```

TABLE 1-continued

```
1261  aagctgattc ccccgcagcc aacgggccgc ccttccccg cgcccctgc cgtcccaccc
1321  gccgcctcgc ccgtgatgcc accgcagacc cagtccccg ggcagccggc ccagcccgcg
1381  cccatggtgc cactgcacca gaagcagagc cgcatcaccc ccatccagaa gccgcggggc
1441  ctcgaccctg tggagatcct gcaggagcgc gagtacaggc tgcaggctcg catcgcacac
1501  cgaattcagg aacttgaaaa ccttcccggg tccctggccg gggatttgcg aaccaaagcg
1561  accattgagc tcaaggccct caggctgctg aacttccaga ggcagctgcg ccaggaggtg
1621  gtggtgtgca tgcggaggga cacagcgctg gagacagccc tcaatgctaa ggcctacaag
1681  cgcagcaagc gccagtccct gcgcgaggcc cgcatcactg agaagctgga gaagcagcag
1741  aagatcgagc aggagcgcaa gcgccggcag aagcaccagg aatacctcaa tagcattctc
1801  cagcatgcca aggatttcaa ggaatatcac agatccgtca caggcaaaat ccagaagctg
1861  accaaggcag tggccacgta ccatgccaac acggagcggg agcagaagaa agagaacgag
1921  cggatcgaga aggagcgcat gcggaggctc atggctgaag atgaggaggg gtaccgcaag
1981  ctcatcgacc agaagaagga caagcgcctg gcctacctct tgcagcagac agacgagtac
2041  gtggctaacc tcacggagct ggtgcggcag cacaaggctg cccaggtcgc caaggagaaa
2101  aagaagaaaa agaaaaagaa gaaggcagaa aatgcagaag acagacgcc tgccattggg
2161  ccggatggcg agcctctgga cgagaccagc cagatgagcg acctcccggt gaaggtgatc
2221  cacgtggaga gtgggaagat cctcacaggc acagatgccc ccaaagccgg gcagctggag
2281  gcctggctcg agatgaaccc ggggtatgaa gtagctccga ggtctgatag tgaagaaagt
2341  ggctcagaag aagaggaaga ggaggaggag gaagagcagc cgcaggcagc acagcctccc
2401  accctgcccg tggaggagaa gaagaagatt ccagatccag acagcgatga cgtctctgag
2461  gtggacgcgc ggcacatcat tgagaatgcc aagcaagatg tcgatgatga atatggcgtg
2521  tcccaggccc ttgcacgtgg cctgcagtcc tactatgccg tggcccatgc tgtcactgag
2581  agagtggaca gcagtcagc gcttatggtc aatggtgtcc tcaaacagta ccagatcaaa
2641  ggtttggagt ggctggtgtc cctgtacaac aacaacctga acggcatcct ggccgacgag
2701  atgggcctgg ggaagaccat ccagaccatc gcgctcatca cgtacctcat ggagcacaaa
2761  cgcatcaatg gcccccttcct catcatcgtg cctctctcaa cgctgtccaa ctgggcgtac
2821  gagtttgaca gtgggcccc ctccgtggtg aaggtgtctt acaagggatc cccagcagca
2881  agacgggcct ttgtccccca gctccggagt gggaagttca acgtcttgct gacgacgtac
2941  gagtacatca tcaaagacaa gcacatcctc gccaagatcc gttggaagta catgattgtg
3001  gacgaaggtc accgcatgaa gaaccaccac tgcaagctga cgcaggtgct caacacgcac
3061  tatgtggcac cccgccgcct gctgctgacg gcacaccgc tgcagaacaa gcttcccgag
3121  ctctgggcgc tgctcaactt cctgctgccc accatcttca gagctgcag caccttcgag
3181  cagtggttta acgcacccct tgccatgacc ggggaaaagg tggacctgaa tgaggaggaa
3241  accattctca tcatccggcg tctccacaaa gtgctgcggc ccttcttgct ccgacgactc
3301  aagaaggaag tcgaggccca gttgcccgaa aaggtggagt acgtcatcaa gtgcgacatg
3361  tctgcgctgc agcgagtgct ctaccgccac atgcaggcca agggcgtgct gctgactgat
3421  ggctccgaga aggacaagaa gggcaaaggc ggcaccaaga ccctgatgaa caccatcatg
3481  cagctgcgga agatctgcaa ccaccctac atgttccagc acatcgagga gtccttttcc
3541  gagcacttgg ggttcactgg cggcattgtc caagggctgg acctgtaccg agcctcgggt
3601  aaatttgagc ttcttgatag aattcttccc aaaactccgag caaccaacca caaagtgctg
```

TABLE 1-continued

```
3661 ctgttctgcc aaatgacctc cctcatgacc atcatggaag attactttgc gtatcgcggc
3721 tttaaatacc tcaggcttga tggaaccacg aaggcggagg accggggcat gctgctgaaa
3781 accttcaacg agcccggctc tgagtacttc atcttcctgc tcagcacccg ggctgggggg
3841 ctcggcctga acctccagtc ggcagacact gtgatcattt ttgacagcga ctggaatcct
3901 caccaggacc tgcaagcgca ggaccgagcc caccgcatcg gcagcagaa cgaggtgcgt
3961 gtgctccgcc tctgcaccgt caacagcgtg gaggagaaga tcctagctgc agccaagtac
4021 aagctcaacg tggaccagaa ggtgatccag gccggcatgt tcgaccagaa gtcctccagc
4081 catgagcggc gcgccttcct gcaggccatc ctggagcacg aggagcagga tgagagcaga
4141 cactgcagca cgggcagcgg cagtgccagc ttcgcccaca ctgcccctcc gccagcgggc
4201 gtcaaccccg acttggagga gccacctcta aaggaggaag cgaggtgcc cgacgacgag
4261 accgtcaacc agatgatcgc ccggcacgag gaggagtttg atctgttcat gcgcatggac
4321 ctggaccgca ggcgcgagga ggcccgcaac cccaagcgga gccgcgcct catggaggag
4381 gacgagctcc cctcgtggat catcaaggac gacgcggagg tggagcggct gacctgtgag
4441 gaggaggagg agaagatgtt cggccgtggc tcccgccacc gcaaggaggg ggactacagc
4501 gactcactga cggagaagca gtggctcaag gccatcgagg agggcacgct ggaggagatc
4561 gaagaggagg tccggcagaa gaaatcatca cggaagcgca agcgagacag cgacgccggc
4621 tcctccaccc cgaccaccag cacccgcagc cgcgacaagg acgacgagag caagaagcag
4681 aagaagcgcg gcggccgcc tgccgagaaa ctctcccta acccacccaa cctcaccaag
4741 aagatgaaga agattgtgga tgccgtgatc aagtacaagg acagcagcag tggacgtcag
4801 ctcagcgagg tcttcatcca gctgccctcg cgaaaggagc tgcccgagta ctacgagctc
4861 atccgcaagc ccgtggactt caagaagata aaggagcgca ttcgcaacca caagtaccgc
4921 agcctcaacg acctagaaa ggacgtcatg ctcctgtgcc agaacgcaca gaccttcaac
4981 ctggagggct ccctgatcta tgaagactcc atcgtcttgc agtcggtctt caccagcgtg
5041 cggcagaaaa tcgagaagga ggatgacagt gaaggcgagg agagtgagga ggaggaagag
5101 ggcgaggagg aaggctccga atccgaatct cggtccgtca aagtgaagat caagcttggc
5161 cggaaggaga aggcacagga ccggctgaag gcggccggc ggcggccgag ccgagggtcc
5221 cgagccaagc cggtcgtgag tgacgatgac agtgaggagg aacaagagga ggaccgctca
5281 ggaagtggca gcgaagaaga ctgagccccg acattccagt ctcgaccccg agcccctcgt
5341 tccagagctg agatggcata ggccttagca gtaacgggta gcagcagatg tagtttcaga
5401 cttggagtaa aactgtataa acaaaagaat cttccatatt tatacagcag agaagctgta
5461 ggactgtttg tgactggccc tgtcctggca tcagtagcat ctgtaacagc attaactgtc
5521 ttaaagagag agagagagaa ttccgaattg gggaacacac gatacctgtt tttcttttcc
5581 gttgctggca gtactgttgc gccgcagttt ggagtcactg tagttaagtg tggatgcatg
5641 tgcgtcaccg tccactcctc ctactgtatt ttattggaca ggtcagactc gccggggggcc
5701 cggcgagggt atgtcagtgt cactggatgt caaacagtaa taaattaaac caacaacaaa
5761 acgcacagcc aaaaaaaaa
```

SEQ ID NO: 56 Human BRG1 Amino Acid Sequence Isoform B (NP_001122316.1)
```
  1 mstpdpplgg tprpgpspgp gpspgamlgp spgpspgsah smmgpspgpp saghpiptqg
 61 pggypqdnmh qmhkpmesmh ekgmsddpry nqmkgmgmrs gghagmgppp spmdqhsqgy
121 psplggseha sspvpasgps sgpqmssgpg gapldgadpq algqqnrgpt pfnqnqlhql
181 ragimaykml argqplpdhl qmavqgkrpm pgmqqqmptl pppsysatgp gpgpgpgpgp
```

TABLE 1-continued

```
 241  gpgpappnys rphgmggpnm pppgpsgvpp gmpgqppggp pkpwpegpma naaaptstpq
 301  klippqptgr pspappavpp aaspvmppqt gspggpagpa pmvplhqkqs ritpiqkprg
 361  ldpveilger eyrlgariah rigelenlpg slagdlrtka tielkalrll nfqrqlrgev
 421  vvcmrrdtal etalnakayk rskrqslrea riteklekqg kiegerkrrq khqeylnsil
 481  qhakdfkeyh rsvtgkiqkl tkavatyhan tereqkkene riekermrrl maedeegyrk
 541  lidqkkdkrl ayllqqtdey vanitelvrq hkaaqvakek kkkkkkkkae naegqtpaig
 601  pdgepldets qmsdlpvkvi hvesgkiltg tdapkagqle awlemnpgye vaprsdsees
 661  gseeeeeeee eeqpqaaqpp tlpveekkki pdpsdddvse vdarhiiena kqdvddeygv
 721  sgalarglqs yyavahavte rvdkqsalmv ngvlkqyqik glewlvslyn nnlngilade
 781  mglgktiqti alitylmehk ringpfliiv plstlsnway efdkwapsvv kvsykgspaa
 841  rrafvpqlrs gkfnvlltty eyiikdkhil akirwkymiv deghrmknhh ckltqvinth
 901  yvaprrlllt gtplqnklpe lwallnfllp tifkscstfe qwfnapfamt gekvdlneee
 961  tiliirrlhk vlrpfllrrl kkeveaqlpe kveyvikcdm salqrvlyrh mqakgvlltd
1021  gsekdkkgkg gtktlmntim qlrkicnhpy mfqhieeesfs ehlgftggiv qgldlyrasg
1081  kfelldrilp klratnhkvl lfcgmtslmt imedyfayrg fkylrldgtt kaedrgmllk
1141  tfnepgseyf ifllstragg lglnlqsadt viifdsdwnp hqdlqaqdra hrigqgnevr
1201  vlrlctvnsv eekilaaaky klnvdqkviq agmfdqksss herraflqai leheeqdesr
1261  hcstgsgsas fahtapppag vnpdleeppl keedevpdde tvnqmiarhe eefdlfmrmd
1321  ldrrreearn pkrkprlmee delpswiikd daeverltce eeeekmfgrg srhrkevdys
1381  dsltekqwlk aieegtleei eeevrqkkss rkrkrdsdag sstpttstrs rdkddeskkq
1441  kkrgrppaek lspnppnitk kmkkivdavi kykdsssgrq lsevfiqlps rkelpeyyel
1501  irkpvdfkki kerirnhkyr slndlekdvm llcgnagtfn legsliyeds ivlqsvftsv
1561  rqkiekedds egeeseeeee geeegseses rsvkvkiklg rkekaqdrlk ggrrrpsrgs
1621  rakpvvsddd seeeqeedrs gsgseed
```

SEQ ID NO: 57 Human BRG1 cDNA Sequence Variant 3 (NM_003072.3, CDS: from 285 to 5228)

```
   1  ggagaggccg ccgcggtgct gaggggagg ggagccggcg agcgcgcgcg cagcgggggc
  61  gcgggtggcg cgcgtgtgtg tgaaggggg gcgtggccg aggcgggcgg gcgcgcgcgc
 121  gaggcttccc ctcgtttggc ggcggcggcg gcttctttgt ttcgtgaaga gaagcgagac
 181  gcccattctg cccccggccc cgcgcggagg ggcggggag gcgccgggaa gtcgacggcg
 241  ccggcggctc ctgcaggagg ccactgtctg cagctcccgt gaagatgtcc actccagacc
 301  caccccctggg cggaactcct cggccaggtc cttccccggg ccctggccct tcccctggag
 361  ccatgctggg ccctagcccg ggtccctcgc cgggctccgc ccacagcatg atggggccca
 421  gcccagggcc gccctcagca ggacacccca tccccaccca ggggcctgga gggtacccct
 481  aggacaacat gcaccagatg cacaagccca tggagtccat gcatgagaag ggcatgtcgg
 541  acgacccgcg ctacaaccag atgaaaggaa tggggatgcg gtcaggggc catgctggga
 601  tggggccccc gcccagcccc atggaccagc actcccaagg ttacccctcg ccctgggtg
 661  gctctgagca tgcctctagt ccagttccag ccagtggccc gtcttcgggg ccccagatgt
 721  cttccgggcc aggaggtgcc ccgctggatg tgctgacccc caggccttg gggcagcaga
 781  accggggccc aaccccattt aaccagaacc agctgcacca gctcagagct cagatcatgg
 841  cctacaagat gctggccagg gggcagcccc tccccgacca cctgcagatg gcggtgcagg
```

TABLE 1-continued

```
 901  gcaagcggcc gatgcccggg atgcagcagc agatgccaac gctacctcca ccctcggtgt
 961  ccgcaacagg acccggccct ggccctggcc ctggccccgg cccgggtccc ggcccggcac
1021  ctccaaatta cagcaggcct catggtatgg gagggcccaa catgcctccc ccaggaccct
1081  cgggcgtgcc ccccgggatg ccaggccagc ctcctggagg gcctcccaag ccctggcctg
1141  aaggacccat ggcgaatgct gctgccccca cgagcacccc tcagaagctg attccccgc
1201  agccaacggg ccgcccttcc cccgcgcccc ctgccgtccc acccgccgcc tcgcccgtga
1261  tgccaccgca gacccagtcc cccgggcagc cggcccagcc cgcgcccatg gtgccactgc
1321  accagaagca gagccgcatc acccccatcc agaagccgcg gggcctcgac cctgtggaga
1381  tcctgcagga gcgcgagtac aggctgcagg ctcgcatcgc acaccgaatt caggaacttg
1441  aaaaccttcc cgggtccctg gccggggatt tgcgaaccaa agcgaccatt gagctcaagg
1501  ccctcaggct gctgaacttc cagaggcagc tgcgccagga ggtggtggtg tgcatgcgga
1561  gggacacagc gctggagaca gccctcaatg ctaaggccta caagcgcagc aagcgccagt
1621  ccctgcgcga ggcccgcatc actgagaagc tggagaagca gcagaagatc gagcaggagc
1681  gcaagcgccg gcagaagcac caggaatacc tcaatagcat tctccagcat gccaaggatt
1741  tcaaggaata tcacagatcc gtcacaggca aaatccagaa gctgaccaag gcagtggcca
1801  cgtaccatgc caacacggag cgggagcaga agaaagagaa cgagcggatc gagaaggagc
1861  gcatgcggag gctcatggct gaagatgagg aggggtaccg caagctcatc gaccagaaga
1921  aggacaagcg cctggcctac ctccttgcag cagacagacga gtacgtggcc aacctcacgg
1981  agctggtgcg gcagcacaag gctgcccagg tcgccaagga gaaaaagaag aaaaagaaaa
2041  agaagaaggc agaaaatgca gaaggacaga cgcctgccat tgggccggat ggcgagcctc
2101  tggacgagac cagccagatg agcgacctcc cggtgaaggt gatccacgtg gagagtggga
2161  agatcctcac aggcacagat gcccccaaag ccgggcagct ggaggcctgg ctcgagatga
2221  acccggggta tgaagtagct ccgaggtctg atagtgaaga agtggctca gaagaagagg
2281  aagaggagga ggaggaagag cagccgcagg cagcacagcc tcccaccctg cccgtggagg
2341  agaagaagaa gattccagat ccagacagcg atgacgtctc tgaggtggac gcgcggcaca
2401  tcattgagaa tgccaagcaa gatgtcgatg atgaatatgg cgtgtcccag gcccttgcac
2461  gtggcctgca gtcctactat gccgtggccc atgctgtcac tgagagagtg acaagcagt
2521  cagcgcttat ggtcaatggt gtcctcaaac agtaccagat caaaggtttg gagtggctgg
2581  tgtccctgta caacaacaac ctgaacggca tcctggccga cgagatgggc tggggaaga
2641  ccatccagac catcgcgctc atcacgtacc tcatggagca caaacgcatc aatgggccct
2701  tcctcatcat cgtgcctctc tcaacgctgt ccaactgggc gtacgagttt gacaagtggg
2761  ccccctccgt ggtgaaggtg tcttacaagg gatcccagc agcaagacgg gcctttgtcc
2821  cccagctccg gagtgggaag ttcaacgtct tgctgacgac gtacgagtac atcatcaaag
2881  acaagcacat cctcgccaag atccgttgga agtacatgat tgtggacgaa ggtcaccgca
2941  tgaagaacca ccactgcaag ctgacgcagg tgctcaacac gcactatgtg cacccccgcc
3001  gcctgctgct gacgggcaca ccgctgcaga acaagcttcc cgagctctgg gcgctgctca
3061  acttcctgct gcccaccatc ttcaagagct gcagcacctt cgagcagtgg tttaacgcac
3121  ccttttgccat gaccggggaa aaggtggacc tgaatgagga ggaaaccatt ctcatcatcc
3181  ggcgtctcca caaagtgctg cggcccttct tgctccgacg actcaagaag gaagtcgagg
3241  cccagttgcc cgaaaaggtg gagtacgtca tcaagtgcga catgtctgcg ctgcagcgag
```

TABLE 1-continued

```
3301  tgctctaccg ccacatgcag gccaagggcg tgctgctgac tgatggctcc gagaaggaca
3361  agaagggcaa aggcggcacc aagaccctga tgaacaccat catgcagctg cggaagatct
3421  gcaaccaccc ctacatgttc cagcacatcg aggagtcctt ttccgagcac ttggggttca
3481  ctggcggcat tgtccaaggg ctggacctgt accgagcctc gggtaaattt gagcttcttg
3541  atagaattct tcccaaactc cgagcaacca accacaaagt gctgctgttc tgccaaatga
3601  cctccctcat gaccatcatg gaagattact ttgcgtatcg cggctttaaa tacctcaggc
3661  ttgatggaac cacgaaggcg gaggaccggg gcatgctgct gaaaaccttc aacgagcccg
3721  gctctgagta cttcatcttc ctgctcagca cccgggctgg ggggctcggc ctgaacctcc
3781  agtcggcaga cactgtgatc attttttgaca gcgactggaa tcctcaccag gacctgcaag
3841  cgcaggaccg agcccaccgc atcgggcagc agaacgaggt gcgtgtgctc cgcctctgca
3901  ccgtcaacag cgtggaggag aagatcctag ctgcagccaa gtacaagctc aacgtggacc
3961  agaaggtgat ccaggccggc atgttcgacc agaagtcctc cagccatgag cggcgcgcct
4021  tcctgcaggc catcctggag cacgaggagc aggatgagag cagacactgc agcacgggca
4081  gcggcagtgc cagcttcgcc cacactgccc ctccgccagc gggcgtcaac cccgacttgg
4141  aggagccacc tctaaaggag gaagacgagg tgcccgacga cgagaccgtc aaccagatga
4201  tcgcccggca cgaggaggag tttgatctgt tcatgcgcat ggacctggac cgcaggcgcg
4261  aggaggcccg caaccccaag cggaagccgc gcctcatgga ggaggacgag ctcccctcgt
4321  ggatcatcaa ggacgacgcg gaggtggagc ggctgacctg tgaggaggag gaggagaaga
4381  tgttcggccg tggctcccgc caccgcaagg aggtggacta cagcgactca ctgacggaga
4441  agcagtggct caaggccatc gaggagggca cgctggagga gatcgaagag gaggtccggc
4501  agaagaaatc atcacggaag cgcaagcgag acagcgacgc cggctcctcc accccgacca
4561  ccagcacccg cagccgcgac aaggacgacg agagcaagaa gcagaagaag cgcgggcggc
4621  cgcctgccga gaaactctcc cctaacccac ccaacctcac caagaagatg aagaagattg
4681  tggatgccgt gatcaagtac aaggacagca gcagtggacg tcagctcagc gaggtcttca
4741  tccagctgcc ctcgcgaaag gagctgcccg agtactacga gctcatccgc aagcccgtgg
4801  acttcaagaa gataaaggag cgcattcgca accacaagta ccgcagcctc aacgacctag
4861  agaaggacgt catgctcctg tgccagaacg cacagacctt caacctggag ggctccctga
4921  tctatgaaga ctccatcgtc ttgcagtcgg tcttcaccag cgtgcggcag aaaatcgaga
4981  aggaggatga cagtgaaggc gaggagagtg aggaggagga gagggcgag gaggaaggct
5041  ccgaatccga atctcggtcc gtcaaagtga agatcaagct tggccggaag gagaaggcac
5101  aggaccggct gaagggcggc cggcggcggc cgagccgagg gtcccgagcc aagccggtcg
5161  tgagtgacga tgacagtgag gaggaacaag aggaggaccg ctcaggaagt ggcagcgaag
5221  aagactgagc cccgacattc cagtctcgac cccgagcccc tcgttccaga gctgagatgg
5281  cataggcctt agcagtaacg ggtagcagca gatgtagttt cagacttgga gtaaaactgt
5341  ataaacaaaa gaatcttcca tatttataca gcagagaagc tgtaggactg tttgtgactg
5401  gccctgtcct ggcatcagta gcatctgtaa cagcattaac tgtcttaaag agagagagag
5461  agaattccga attggggaac acacgatacc tgttttttctt ttccgttgct ggcagtactg
5521  ttgcgccgca gtttggagtc actgtagtta agtgtggatg catgtgcgtc accgtccact
5581  cctcctactg tatttttattg gacaggtcag actcgccggg ggcccggcga gggtatgtca
```

TABLE 1-continued

```
5641 gtgtcactgg atgtcaaaca gtaataaatt aaaccaacaa caaaacgcac agccaaaaaa
5701 aaa
```

SEQ ID NO: 58 Human BRG1 cDNA Sequence Variant 4 (NM_001128845.1, CDS: from 1 to 4854)

```
   1 atgtccactc cagacccacc cctgggcgga actcctcggc caggtccttc cccgggccct
  61 ggcccttccc ctggagccat gctgggccct agcccgggtc cctcgccggg ctccgcccac
 121 agcatgatgg ggcccagccc agggccgccc tcagcaggac accccatccc cacccagggg
 181 cctggagggt accctcagga caacatgcac cagatgcaca agcccatgga gtccatgcat
 241 gagaagggca tgtcggacga cccgcgctac aaccagatga aggaatggga tgcggtca
 301 gggggccatg ctgggatggg gccccgccc agcccatgg accagcactc caaggttac
 361 ccctcgcccc tgggtggctc tgagcatgcc tctagtccag ttccagccag tggcccgtct
 421 tcggggcccc agatgtcttc cgggccagga ggtgccccgc tggatggtgc tgaccccag
 481 gccttggggc agcagaaccg ggcccaacc ccatttaacc agaaccagct gcaccagctc
 541 agagctcaga tcatggccta caagatgctg gccaggggc agcccctccc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcacctcc aaattacagc aggcctcatg gtatgggagg gcccaacatg
 781 cctcccccag gaccctcggg cgtgccccc gggatgccag gccagcctcc tggagggcct
 841 cccaagccct ggcctgaagg acccatggcg aatgctgctg ccccacgag cacccctcag
 901 aagctgattc ccccgcagcc aacgggccgc ccttcccccg cgcccctgc cgtcccaccc
 961 gccgcctcgc ccgtgatgcc accgcagacc cagtccccg ggcagccggc ccagcccgcg
1021 cccatggtgc cactgcacca gaagcagagc cgcatcaccc ccatccagaa gccgcggggc
1081 ctcgaccctg tggagatcct gcaggacgc gagtacaggc tgcaggctcg catcgcacac
1141 cgaattcagg aacttgaaaa ccttcccggg tccctggccg gggatttgcg aaccaaagcg
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct cgcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaagaa agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag acagacgcc tgccattggg
1801 ccggatggcg agcctctgga cgagaccagc cagatgagcg acctccccgg gaaggtgatc
1861 cacgtggaga gtggaagat cctcacaggc acagatgccc caaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
```

TABLE 1-continued

```
2221  agagtggaca agcagtcagc gcttatggtc aatggtgtcc tcaaacagta ccagatcaaa
2281  ggtttggagt ggctggtgtc cctgtacaac aacaacctga acggcatcct ggccgacgag
2341  atgggcctgg ggaagaccat ccagaccatc gcgctcatca cgtacctcat ggagcacaaa
2401  cgcatcaatg ggcccttcct catcatcgtg cctctctcaa cgctgtccaa ctgggcgtac
2461  gagtttgaca gtgggcccc ctccgtggtg aaggtgtctt acaagggatc cccagcagca
2521  agacgggcct ttgtccccca gctccggagt gggaagttca acgtcttgct gacgacgtac
2581  gagtacatca tcaaagacaa gcacatcctc gccaagatcc gttggaagta catgattgtg
2641  gacgaaggtc accgcatgaa gaaccaccac tgcaagctga cgcaggtgct caacacgcac
2701  tatgtggcac cccgccgcct gctgctgacg ggcacaccgc tgcagaacaa gcttcccgag
2761  ctctgggcgc tgctcaactt cctgctgccc accatcttca agagctgcag caccttcgag
2821  cagtggttta acgcacccct tgccatgacc ggggaaaagg tggacctgaa tgaggaggaa
2881  accattctca tcatccggcg tctccacaaa gtgctgcggc ccttcttgct ccgacgactc
2941  aagaaggaag tcgaggccca gttgcccgaa aaggtggagt acgtcatcaa gtgcgacatg
3001  tctgcgctgc agcgagtgct ctaccgccac atgcaggcca agggcgtgct gctgactgat
3061  ggctccgaga aggacaagaa gggcaaaggc ggcaccaaga ccctgatgaa caccatcatg
3121  cagctgcgga agatctgcaa ccacccctac atgttccagc acatcgagga gtcctttttcc
3181  gagcacttgg ggttcactgg cggcattgtc caagggctgg acctgtaccg agcctcgggt
3241  aaatttgagc ttcttgatag aattcttccc aaactccgag caaccaacca caaagtgctg
3301  ctgttctgcc aaatgacctc cctcatgacc atcatggaag attactttgc gtatcgcggc
3361  tttaaatacc tcaggcttga tggaaccacg aaggcggagg accggggcat gctgctgaaa
3421  accttcaacg agcccggctc tgagtacttc atcttcctgc tcagcacccg ggctgggggg
3481  ctcggcctga acctccagtc ggcagacact gtgatcattt ttgacagcga ctggaatcct
3541  caccaggacc tgcaagcgca ggaccgagcc caccgcatcg ggcagcagaa cgaggtgcgt
3601  gtgctccgcc tctgcaccgt caacagcgtg gaggagaaga tcctagctgc agccaagtac
3661  aagctcaacg tggaccagaa ggtgatccag gccggcatgt tcgaccagaa gtcctccagc
3721  catgagcggc gcgccttcct gcaggccatc ctggagcacg aggagcagga tgaggaggaa
3781  gacgaggtgc ccgacgacga gaccgtcaac cagatgatcg cccggcacga ggagagtttt
3841  gatctgttca tgcgcatgga cctggaccgc aggcgcgagg aggcccgcaa ccccaagcgg
3901  aagccgcgcc tcatggagga ggacgagctc ccctcgtgga tcatcaagga cgacgcggag
3961  gtggagcggc tgacctgtga ggaggaggag gagaagatgt tcggccgtgg ctcccgccac
4021  cgcaaggagg tggactacag cgactcactg acgagaagc agtggctcaa gaccctgaag
4081  gccatcgagg agggcacgct ggaggagatc gaagaggagg tccggcagaa gaaatcatca
4141  cggaagcgca agcgagacag cgacgccggc tcctccaccc cgaccaccag caccgcagc
4201  cgcgacaagg acgacgagag caagaagcag aagaagcgcg gcggccgcc tgccgagaaa
4261  ctctcccta acccacccaa cctcaccaag aagatgaaga agattgtgga tgccgtgatc
4321  aagtacaagg acagcagcag tggacgtcag ctcagcgagg tcttcatcca gctgccctcg
4381  cgaaaggagc tgcccgagta ctacgagctc atccgcaagc ccgtggactt caagaagata
4441  aaggagcgca ttcgcaacca caagtaccgc agcctcaacg acctagaaa ggacgtcatg
4501  ctcctgtgcc agaacgcaca gaccttcaac ctggagggct ccctgatcta tgaagactcc
4561  atcgtcttgc agtcggtctt caccagcgtg cggcagaaaa tcgagaagga ggatgacagt
```

TABLE 1-continued

```
4621  gaaggcgagg agagtgagga ggaggaagag ggcgaggagg aaggctccga atccgaatct
4681  cggtccgtca aagtgaagat caagcttggc cggaaggaga aggcacagga ccggctgaag
4741  ggcggccggc ggcggccgag ccgagggtcc cgagccaagc cggtcgtgag tgacgatgac
4801  agtgaggagg aacaagagga ggaccgctca ggaagtggca gcgaagaaga ctgagccccg
4861  acattccagt ctcgaccccg agccctcgt tccagagctg agatggcata ggccttagca
4921  gtaacgggta gcagcagatg tagtttcaga cttggagtaa aactgtataa acaaaagaat
4981  cttccatatt tatacagcag agaagctgta ggactgtttg tgactggccc tgtcctggca
5041  tcagtagcat ctgtaacagc attaactgtc ttaaagagag agagagagaa ttccgaattg
5101  gggaacacac gatacctgtt tttcttttcc gttgctggca gtactgttgc gccgcagttt
5161  ggagtcactg tagttaagtg tggatgcatg tgcgtcaccg tccactcctc ctactgtatt
5221  ttattggaca ggtcagactc gccgggggcc cggcgagggt atgtcagtgt cactggatgt
5281  caaacagtaa taaattaaac caacaacaaa acgcacagcc aaaaaaaaa
```

SEQ ID NO: 59 Human BRG1 Amino Acid Sequence Isoform C (NP_001122317.1)

```
   1  mstpdpplgg tprpgpspgp gpspgamlgp spgpspgsah smmgpspgpp saghpiptqg
  61  pggypqdnmh qmhkpmesmh ekgmsddpry nqmkgmgmrs gghagmgppp spmdqhsqgy
 121  psplggseha sspvpasgps sgpqmssgpg gapldgadpq algqqnrgpt pfnqnqlhql
 181  ragimaykml argqplpdhl qmavqgkrpm pgmqqqmptl pppsysatgp gpgpgpgpgp
 241  gpgpappnys rphgmggpnm pppgpsgvpp gmpgqppggp pkpwpegpma naaaptstpq
 301  klippqptgr pspappavpp aaspvmppqt gspggpagpa pmvplhqkqs ritpiqkprg
 361  ldpveilger eyrlgariah rigelenlpg slagdlrtka tielkalrll nfqrqlrgev
 421  vvcmrrdtal etalnakayk rskrqslrea riteklekqg kiegerkrrq khqeylnsil
 481  qhakdfkeyh rsvtgkiqkl tkavatyhan tereqkkene riekermrrl maedeegyrk
 541  lidqkkdkrl ayllqqtdey vanitelvrq hkaaqvakek kkkkkkkae naegqtpaig
 601  pdgepldets qmsdlpvkvi hvesgkiltg tdapkagqle awlemnpgye vaprsdsees
 661  gseeeeeeee eeqpqaaqpp tlpveekkki pdpdsddvse vdarhiiena kqdvddeygv
 721  sgalarglqs yyavahavte rvdkqsalmv ngvlkqyqik glewlvslyn nnlngilade
 781  mglgktiqti alitylmehk ringpfliiv plstlsnway efdkwapsvv kvsykgspaa
 841  rrafvpqlrs gkfnvlltty eyiikdkhil akirwkymiv deghrmknhh ckltqvinth
 901  yvaprrlllt gtplqnklpe lwallnfllp tifkscstfe qwfnapfamt gekvdlneee
 961  tiliirrlhk vlrpfllrrl kkeveaqlpe kveyvikcdm salqrvlyrh mqakgvlltd
1021  gsekdkkgkg gtktlmntim qlrkicnhpy mfqhieesfs ehlgftggiv qgldlyrasg
1081  kfelldrilp klratnhkvl lfcgmtslmt imedyfayrg fkylrldgtt kaedrgmllk
1141  tfnepgseyf ifllstragg lglnlqsadt viifdsdwnp hqdlqaqdra hrigqgnevr
1201  vlrlctvnsv eekilaaaky klnvdqkviq agmfdqksss herraflqai leheeqdeee
1261  devpddetvn qmiarheeef dlfmrmdldr rreearnpkr kprlmeedel pswiikddae
1321  verltceeee ekmfgrgsrh rkevdysdsl tekqwlktlk aieegtleei eeevrqkkss
1381  rkrkrdsdag sstpttstrs rdkddeskkq kkrgrppaek lspnppnitk kmkkivdavi
1441  kykdsssgrq lsevfiqlps rkelpeyyel irkpvdfkki kerirnhkyr slndlekdvm
1501  llcgnagtfn legsliyeds ivlqsvftsv rqkiekedds egeeseeeee geeegseses
1561  rsvkvkiklg rkekaqdrlk ggrrrpsrgs rakpvvsddd seeeqeedrs gsgseed
```

TABLE 1-continued

SEQ ID NO: 60 Human BRG1 cDNA Sequence Variant 5 (NM_001128846.1, CDS: from 1 to 4851)

```
   1 atgtccactc cagacccacc cctgggcgga actcctcggc caggtccttc cccgggccct
  61 ggcccttccc ctggagccat gctgggccct agcccgggtc cctcgccggg ctccgcccac
 121 agcatgatgg ggcccagccc agggccgccc tcagcaggac acccatccc cacccagggg
 181 cctggagggt accctcagga caacatgcac cagatgcaca agcccatgga gtccatgcat
 241 gagaagggca tgtcggacga cccgcgctac aaccagatga aggaatggg gatgcggtca
 301 gggggccatg ctgggatggg gccccgccc agcccatgg accagcactc ccaaggttac
 361 ccctcgcccc tgggtggctc tgagcatgcc tctagtccag ttccagccag tggcccgtct
 421 tcggggcccc agatgtcttc cgggccagga ggtgccccgc tggatggtgc tgaccccag
 481 gccttgggc agcagaaccg gggcccaacc ccatttaacc agaaccagct gcaccagctc
 541 agagctcaga tcatggccta caagatgctg gccaggggc agcccctcc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtccggcc cggcacctcc aaattacagc aggcctcatg gtatgggagg cccaacatg
 781 cctccccag accctcggg cgtgccccc gggatgccag gccagcctcc tggagggcct
 841 cccaagccct ggcctgaagg acccatggcg aatgctgctg cccccacgag caccccctcag
 901 aagctgattc ccccgcagcc aacgggccgc ccttcccccg cgcccctgc cgtcccaccc
 961 gccgctcgc ccgtgatgcc accgcagacc cagtccccg ggcagccggc ccagcccgcg
1021 cccatggtgc cactgcacca gaagcagagc cgcatcaccc ccatccagaa gccgcggggc
1081 ctcgaccctg tggagatcct gcaggacgc gagtacaggc tgcaggctca catcgcacac
1141 cgaattcagg aacttgaaaa ccttcccggg tccctggccg gggatttgcg aaccaaagcg
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaagaa agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag acagacgcc tgccattggg
1801 ccggatggcg agcctctgga cgagaccagc cagatgagcg acctcccggt gaaggtgatc
1861 cacgtggaga gtgggaagat cctcacaggc acagatgccc caaagccgg cagctggag
1921 gcctggctcg agatgaaccc gggggtatgaa gtagctccga ggtctgatag tgaagaaagt
1981 ggctcagaag aagaggaaga ggaggaggag gaagagcagc cgcaggcagc acagcctccc
2041 accctgccccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca gcagtcagc gcttatggtc aatggtgtcc tcaaacagta ccagatcaaa
2281 ggtttggagt ggctggtgtc cctgtacaac aacaacctga acggcatcct ggccgacgag
```

TABLE 1-continued

```
2341  atgggcctgg ggaagaccat ccagaccatc gcgctcatca cgtacctcat ggagcacaaa
2401  cgcatcaatg ggcccttcct catcatcgtg cctctctcaa cgctgtccaa ctgggcgtac
2461  gagtttgaca agtgggcccc ctccgtggtg aaggtgtctt acaagggatc cccagcagca
2521  agacgggcct ttgtccccca gctccggagt gggaagttca acgtcttgct gacgacgtac
2581  gagtacatca tcaaagacaa gcacatcctc gccaagatcc gttggaagta catgattgtg
2641  gacgaaggtc accgcatgaa gaaccaccac tgcaagctga cgcaggtgct caacacgcac
2701  tatgtggcac cccgccgcct gctgctgacg ggcacaccgc tgcagaacaa gcttcccgag
2761  ctctgggcgc tgctcaactt cctgctgccc accatcttca agagctgcag caccttcgag
2821  cagtggttta acgcacccct tgccatgacc ggggaaaagg tggacctgaa tgaggaggaa
2881  accattctca tcatccggcg tctccacaaa gtgctgcggc ccttcttgct ccgacgactc
2941  aagaaggaag tcgaggccca gttgcccgaa aaggtggagt acgtcatcaa gtgcgacatg
3001  tctgcgctgc agcgagtgct ctaccgccac atgcaggcca agggcgtgct gctgactgat
3061  ggctccgaga aggacaagaa gggcaaaggc ggcaccaaga ccctgatgaa caccatcatg
3121  cagctgcgga agatctgcaa ccacccctac atgttccagc acatcgagga gtccttttcc
3181  gagcacttgg ggttcactgg cggcattgtc caagggctgg acctgtaccg agcctcgggt
3241  aaatttgagc ttcttgatag aattcttccc aaactccgag caaccaacca caaagtgctg
3301  ctgttctgcc aaatgacctc cctcatgacc atcatggaag attactttgc gtatcgcggc
3361  tttaaatacc tcaggcttga tggaaccacg aaggcggagg accggggcat gctgctgaaa
3421  accttcaacg agcccggctc tgagtacttc atcttcctgc tcagcacccg ggctgggggg
3481  ctcggcctga acctccagtc ggcagacact gtgatcattt ttgacagcga ctggaatcct
3541  caccaggacc tgcaagcgca ggaccgagcc caccgcatcg ggcagcagaa cgaggtgcgt
3601  gtgctccgcc tctgcaccgt caacagcgtg gaggagaaga tcctagctgc agccaagtac
3661  aagctcaacg tggaccagaa ggtgatccag gccggcatgt tcgaccagaa gtcctccagc
3721  catgagcggc gcgccttcct gcaggccatc ctggagcacg aggagcagga tgaggaggaa
3781  gacgaggtgc ccgacgacga gaccgtcaac cagatgatcg cccggcacga ggaggagttt
3841  gatctgttca tgcgcatgga cctggaccgc aggcgcgagg aggcccgcaa ccccaagcgg
3901  aagccgcgcc tcatggagga ggacgagctc ccctcgtgga tcatcaagga cgacgcggag
3961  gtggagcggc tgacctgtga ggaggaggag gagaagatgt tcggccgtgg ctcccgccac
4021  cgcaaggagg tggactacag cgactcactg acgagaaagc agtggctcaa gaccctgaag
4081  gccatcgagg agggcacgct ggaggagatc gaagaggagg tccggcagaa gaaatcatca
4141  cggaagcgca agcgagacag cgacgccggc tcctccaccc cgaccaccag caccgcagc
4201  cgcgacaagg acgacgagag caagaagcag aagaagcgcg gcggccgcc tgccgagaaa
4261  ctctccccta acccacccaa cctcaccaag aagatgaaga agattgtgga tgccgtgatc
4321  aagtacaagg acagcagtgg acgtcagctc agcgaggtct tcatccagct gcctcgcga
4381  aaggagctgc ccgagtacta cgagctcatc cgcaagcccg tggacttcaa gaagataaag
4441  gagcgcattc gcaaccacaa gtaccgcagc ctcaacgacc tagagaagga cgtcatgctc
4501  ctgtgccaga acgcacagac cttcaacctg gagggctccc tgatctatga agactccatc
4561  gtcttgcagt cggtcttcac cagcgtgcgg cagaaaatcg agaaggagga tgacagtgaa
4621  ggcgaggaga gtgaggagga ggaagagggc gaggaggaag ctccgaatc cgaatctcgg
4681  tccgtcaaag tgaagatcaa gcttggccgg aaggagaagg cacaggaccg gctgaagggc
```

TABLE 1-continued

```
4741 ggccggcggc ggccgagccg agggtcccga gccaagccgg tcgtgagtga cgatgacagt 4801 gaggaggaac aagaggagga ccgctcagga agtggcagcg aagaagactg agccccgaca 4861 ttccagtctc gaccccgagc ccctcgttcc agagctgaga tggcataggc cttagcagta 4921 acgggtagca gcagatgtag tttcagactt ggagtaaaac tgtataaaca aaagaatctt 4981 ccatatttat acagcagaga agctgtagga ctgtttgtga ctggccctgt cctggcatca 5041 gtagcatctg taacagcatt aactgtctta agagagaga gagagaattc cgaattgggg 5101 aacacacgat acctgttttt cttttccgtt gctggcagta ctgttgcgcc gcagtttgga 5161 gtcactgtag ttaagtgtgg atgcatgtgc gtcaccgtcc actcctccta ctgtattta 5221 ttggacaggt cagactcgcc gggggcccgg cgagggtatg tcagtgtcac tggatgtcaa 5281 acagtaataa attaaaccaa caacaaaacg cacagccaaa aaaaaa
```

SEQ ID NO: 61 Human BRG1 Amino Acid Sequence Isoform D (NP_001122318.1)

```
   1 mstpdpplgg tprpgpspgp gpspgamlgp spgpspgsah smmgpspgpp saghpiptqg 61 pggypqdnmh qmhkpmesmh ekgmsddpry nqmkgmgmrs gghagmgppp spmdqhsqgy 121 psplggseha sspvpasgps sgpqmssgpg gapldgadpq algqqnrgpt pfnqnlhql 181 ragimaykml argqplpdhl qmavqgkrpm pgmqqqmptl pppsysatgp gpgpgpgpgp 241 gpgpappnys rphgmggpnm pppgpsgvpp gmpgqppggp pkpwpegpma naaaptstpq 301 klippqptgr pspappavpp aaspvmppqt gspggpagpa pmvplhqkqs ritpiqkprg 361 ldpveilger eyrlgariah rigelenlpg slagdlrtka tielkalrll nfqrqlrgev 421 vvcmrrdtal etalnakayk rskrqslrea riteklekqg kiegerkrrq khqeylnsil 481 qhakdfkeyh rsvtgkiqkl tkavatyhan tereqkkene riekermrrl maedeegyrk 541 lidqkkdkrl ayllqqtdey vanitelvrq hkaaqvakek kkkkkkkae naegqtpaig 601 pdgepldets qmsdlpvkvi hvesgkiltg tdapkagqle awlemnpgye vaprsdsees 661 gseeeeeeee eeqpqaaqpp tlpveekkki pdpdsddvse vdarhiiena kqdvddeygv 721 sgalarglqs yyavahavte rvdkqsalmv ngvlkqyqik glewlvslyn nnlngilade 781 mglgktiqti alitylmehk ringpfliiv plstlsnway efdkwapsvv kvsykgspaa 841 rrafvpqlrs gkfnvlltty eyiikdkhil akirwkymiv deghrmknhh ckltqvinth 901 yvaprrlllt gtplqnklpe lwallnfllp tifkscstfe qwfnapfamt gekvdlneee 961 tiliirrlhk vlrpfllrrl kkeveaqlpe kveyvikcdm salqrvlyrh mqakgvlltd 1021 gsekdkkgkg gtktlmntim qlrkicnhpy mfqhieeesfs ehlgftggiv qgldlyrasg 1081 kfelldrilp klratnhkvl lfcgmtslmt imedyfayrg fkylrldgtt kaedrgmllk 1141 tfnepgseyf ifllstragg lglnlqsadt viifdsdwnp hqdlqaqdra hrigqgnevr 1201 vlrlctvnsv eekilaaaky klnvdqkviq agmfdqksss herraflqai leheeqdeee 1261 devpddetvn qmiarheeef dlfmrmdldr rreearnpkr kprlmeedel pswiikddae 1321 verltceeee ekmfgrgsrh rkevdysdsl tekqwlktlk aieegtleei eeevrqkkss 1381 rkrkrdsdag sstpttstrs rdkddeskkq kkrgrppaek lspnppnitk kmkkivdavi 1441 kykdssgrql sevfiqlpsr kelpeyyeli rkpvdfkkik erirnhkyrs lndlekdvml 1501 lcgnagtfnl egsliyedsi vlqsvftsvr qkiekeddse geeseeeeeg eeegsesesr 1561 svkvkiklgr kekaqdrlkg grrrpsrgsr akpvvsddds eeeqeedrsg sgseed
```

SEQ ID NO: 62 Human BRG1 cDNA Sequence Variant 6 (NM_001128847.1, CDS: from 1 to 4845)

```
   1 atgtccactc cagacccacc cctgggcgga actcctcggc caggtccttc cccgggccct 61 ggcccttccc ctggagccat gctgggccct agcccgggtc cctcgccggg ctccgcccac
```

TABLE 1-continued

```
 121  agcatgatgg ggcccagccc agggccgccc tcagcaggac accccatccc cacccagggg
 181  cctggagggt accctcagga caacatgcac cagatgcaca agcccatgga gtccatgcat
 241  gagaagggca tgtcggacga cccgcgctac aaccagatga aaggaatggg gatgcggtca
 301  gggggccatg ctgggatggg gcccccgccc agcccatgg accagcactc ccaaggttac
 361  ccctcgcccc tgggtggctc tgagcatgcc tctagtccag ttccagccag tggcccgtct
 421  tcggggcccc agatgtcttc cgggccagga ggtgcccgc tggatggtgc tgacccccag
 481  gccttggggc agcagaaccg gggcccaacc ccatttaacc agaaccagct gcaccagctc
 541  agagctcaga tcatggccta caagatgctg gccaggggc agcccctccc cgaccacctg
 601  cagatggcgg tgcagggcaa gcggccgatg cccgggatgc agcagcagat gccaacgcta
 661  cctccaccct cggtgtccgc aacaggaccc ggccctggcc ctggccctgg ccccggcccg
 721  ggtcccggcc cggcacctcc aaattacagc aggcctcatg gtatgggagg gcccaacatg
 781  cctcccccag gaccctcggg cgtgcccccc gggatgccag gccagcctcc tggagggcct
 841  cccaagccct ggcctgaagg acccatggcg aatgctgctg cccccacgag cacccctcag
 901  aagctgattc cccgcagcc aacgggccgc ccttccccg cgccccctgc cgtcccaccc
 961  gccgcctcgc ccgtgatgcc accgcagacc cagtcccccg ggcagccggc ccagcccgcg
1021  cccatggtgc cactgcacca gaagcagagc cgcatcaccc ccatccagaa gccgcgggc
1081  ctcgaccctg tggagatcct gcaggagcgc gagtacaggc tgcaggctcg catcgcacac
1141  cgaattcagg aacttgaaaa ccttcccggg tccctggccg gggatttgcg aaccaaagcg
1201  accattgagc tcaaggccct caggctgctg aacttccaga ggcagctgcg ccaggaggtg
1261  gtggtgtgca tgcggaggga cacagcgctg gagacagccc tcaatgctaa ggcctacaag
1321  cgcagcaagc gccagtccct gcgcgaggcc cgcatcactg agaagctgga gaagcagcag
1381  aagatcgagc aggagcgcaa gcgccggcag aagcaccagg aatacctcaa tagcattctc
1441  cagcatgcca aggatttcaa ggaatatcac agatccgtca caggcaaaat ccagaagctg
1501  accaaggcag tggccacgta ccatgccaac acggagcggg agcagaagaa agagaacgag
1561  cggatcgaga aggagcgcat gcggaggctc atggctgaag atgaggaggg gtaccgcaag
1621  ctcatcgacc agaagaagga caagcgcctg gcctacctct gcagcagac agacgagtac
1681  gtggctaacc tcacggagct ggtgcggcag cacaaggctg cccaggtcgc aaggagaaa
1741  aagaagaaaa agaaaaagaa gaaggcagaa aatgcagaag gacagacgcc tgccattggg
1801  ccggatggcg agcctctgga cgagaccagc cagatgagcg acctcccggt gaaggtgatc
1861  cacgtggaga gtgggaagat cctcacaggc acagatgccc caaagccgg gcagctggag
1921  gcctggctcg agatgaaccc ggggtatgaa gtagctccga ggtctgatag tgaagaaagt
1981  ggctcagaag aagaggaaga ggaggaggag gaagagcagc cgcaggcagc acagcctccc
2041  accctgcccg tggaggagaa gaagaagatt ccagatccag acagcgatga cgtctctgag
2101  gtggacgcgc ggcacatcat tgagaatgcc aagcaagatg tcgatgatga atatggcgtg
2161  tcccaggccc ttgcacgtgg cctgcagtcc tactatgccg tggcccatgc tgtcactgag
2221  agagtggaca agcagtcagc gcttatggtc aatggtgtcc tcaaacagta ccagatcaaa
2281  ggtttggagt ggctggtgtc cctgtacaac aacaacctga acggcatcct ggccgacgag
2341  atgggcctgg ggaagaccat ccagaccatc gcgctcatca cgtacctcat ggagcacaaa
2401  cgcatcaatg ggcccttcct catcatcgtg cctctctcaa cgctgtccaa ctgggcgtac
2461  gagtttgaca gtgggccccc ctccgtggtg aaggtgtctt acaagggatc cccagcagca
```

TABLE 1-continued

```
2521  agacgggcct tgtccccca gctccggagt gggaagttca acgtcttgct gacgacgtac
2581  gagtacatca tcaaagacaa gcacatcctc gccaagatcc gttggaagta catgattgtg
2641  gacgaaggtc accgcatgaa gaaccaccac tgcaagctga cgcaggtgct caacacgcac
2701  tatgtggcac cccgccgcct gctgctgacg ggcacaccgc tgcagaacaa gcttcccgag
2761  ctctgggcgc tgctcaactt cctgctgccc accatcttca gagctgcag caccttcgag
2821  cagtggttta acgcacccct tgccatgacc ggggaaaagg tggacctgaa tgaggaggaa
2881  accattctca tcatccggcg tctccacaaa gtgctgcggc cttcttgct ccgacgactc
2941  aagaaggaag tcgaggccca gttgcccgaa aaggtggagt acgtcatcaa gtgcgacatg
3001  tctgcgctgc agcgagtgct ctaccgccac atgcaggcca agggcgtgct gctgactgat
3061  ggctccgaga aggacaagaa gggcaaaggc ggcaccaaga ccctgatgaa caccatcatg
3121  cagctgcgga agatctgcaa ccaccactac atgttccagc acatcgagga gtccttttcc
3181  gagcacttgg ggttcactgg cggcattgtc caagggctgg acctgtaccg agcctcgggt
3241  aaatttgagc ttcttgatag aattcttccc aaactccgag caaccaacca caaagtgctg
3301  ctgttctgcc aaatgacctc cctcatgacc atcatggaag attactttgc gtatcgcggc
3361  tttaaatacc tcaggcttga tggaaccacg aaggcggagg accggggcat gctgctgaaa
3421  accttcaacg agcccggctc tgagtacttc atcttcctgc tcagcacccg ggctgggggg
3481  ctcggcctga acctccagtc ggcagacact gtgatcattt ttgacagcga ctggaatcct
3541  caccaggacc tgcaagcgca ggaccgagcc caccgcatcg ggcagcagaa cgaggtgcgt
3601  gtgctccgcc tctgcaccgt caacagcgtg gaggagaaga tcctagctgc agccaagtac
3661  aagctcaacg tggaccagaa ggtgatccag gccggcatgt tcgaccagaa gtcctccagc
3721  catgagcggc gcgccttcct gcaggccatc ctggagcacg aggagcagga tgaggaggaa
3781  gacgaggtgc ccgacgacga gaccgtcaac cagatgatcg cccggcacga ggaggagttt
3841  gatctgttca tgcgcatgga cctggaccgc aggcgcgagg aggcccgcaa ccccaagcgg
3901  aagccgcgcc tcatggagga ggacgagctc ccctcgtgga tcatcaagga cgacgcggag
3961  gtggagcggc tgacctgtga ggaggaggag gagaagatgt tcggccgtgg ctcccgccac
4021  cgcaaggagg tggactacag cgactcactg acggagaagc agtggctcaa ggccatcgag
4081  gagggcacgc tggaggagat cgaagaggag gtccggcaga agaaatcatc acggaagcgc
4141  aagcgagaca gcgacgccgg ctcctccacc ccgaccacca gcacccgcag ccgcgacaag
4201  gacgacgaga gcaagaagca gaagaagcgc gggcggccgc ctgccgagaa actctcccct
4261  aacccaccca acctcaccaa gaagatgaag aagattgtgg atgccgtgat caagtacaag
4321  gacagcagca gtggacgtca gctcagcgag gtcttcatcc agctgccctc gcgaaaggag
4381  ctgcccgagt actacgagct catccgcaag cccgtggact tcaagaagat aaaggagcgc
4441  attcgcaacc acaagtaccg cagcctcaac gacctagaga aggacgtcat gctcctgtgc
4501  cagaacgcac agaccttcaa cctggagggc tccctgatct atgaagactc catcgtcttg
4561  cagtcggtct tcaccagcgt gcggcagaaa atcgagaagg aggatgacag tgaaggcgag
4621  gagagtgagg aggaggaaga gggcgaggag gaaggctccg aatccgaatc tcggtccgtc
4681  aaagtgaaga tcaagcttgg ccggaaggag aaggcacagg accggctgaa gggcggccgg
4741  cggcggccga gccgagggtc ccgagccaag ccggtcgtga gtgacgatga cagtgaggag
4801  gaacaagagg aggaccgctc aggaagtggc agcgaagaag actgagcccc gacattccag
4861  tctcgacccc gagcccctcg ttccagagct gagatggcat aggccttagc agtaacgggt
```

TABLE 1-continued

```
4921  agcagcagat gtagtttcag acttggagta aaactgtata acaaaagaa tcttccatat 4981  ttatacagca gagaagctgt aggactgttt gtgactggcc ctgtcctggc atcagtagca 5041  tctgtaacag cattaactgt cttaaagaga gagagagaga attccgaatt ggggaacaca 5101  cgatacctgt ttttcttttc cgttgctggc agtactgttg cgccgcagtt tggagtcact 5161  gtagttaagt gtggatgcat gtgcgtcacc gtccactcct cctactgtat tttattggac 5221  aggtcagact cgccgggggc cggcgaggg tatgtcagtg tcactggatg tcaaacagta 5281  ataaattaaa ccaacaacaa aacgcacagc caaaaaaaaa
```

SEQ ID NO: 63 Human BRG1 Amino Acid Sequence Isoform E (NP_001122319.1)

```
   1  mstpdpplgg tprpgpspgp gpspgamlgp spgpspgsah smmgpspgpp saghpiptqg 61  pggypqdnmh qmhkpmesmh ekgmsddpry nqmkgmgmrs gghagmgppp spmdqhsqgy 121  psplggseha sspvpasgps sgpqmssgpg gapldgadpq algqqnrgpt pfnqnqlhql 181  ragimaykml argqplpdhl qmavqgkrpm pgmqqqmptl pppsysatgp gpgpgpgpgp 241  gpgpappnys rphgmggpnm pppgpsgvpp gmpgqppgp pkpwpegpma naaaptstpq 301  klippqptgr pspappavpp aaspvmppqt gspggpagpa pmvplhqkqs ritpiqkprg 361  ldpveilger eyrlgariah rigelenlpg slagdlrtka tielkalrll nfqrqlrgev 421  vvcmrrdtal etalnakayk rskrqslrea riteklekqg kiegerkrrq khqeylnsil 481  qhakdfkeyh rsvtgkiqkl tkavatyhan tereqkkene riekermrrl maedeegyrk 541  lidqkkdkrl ayllqqtdey vanitelvrq hkaaqvakek kkkkkkkae naegqtpaig 601  pdgepldets qmsdlpvkvi hvesgkiltg tdapkagqle awlemnpgye vaprsdsees 661  gseeeeeeee eeqpqaaqpp tlpveekkki pdpdsddvse vdarhiiena kqdvddeygv 721  sgalarglqs yyavahavte rvdkqsalmv ngvlkqyqik glewlvslyn nnlngilade 781  mglgktiqti alitylmehk ringpfliiv plstlsnway efdkwapsvv kvsykgspaa 841  rrafvpqlrs gkfnvlltty eyiikdkhil akirwkymiv deghrmknhh ckltqvinth 901  yvaprrlllt gtplqnklpe lwallnfllp tifkscstfe qwfnapfamt gekvdlneee 961  tiliirrlhk vlrpfllrrl kkeveaqlpe kveyvikcdm salqrvlyrh mqakgvlltd 1021  gsekdkkgkg gtktlmntim qlrkicnhpy mfqhieessfs ehlgftggiv qgldlyrasg 1081  kfelldrilp klratnhkvl lfcgmtslmt imedyfayrg fkylrldgtt kaedrgmllk 1141  tfnepgseyf iflllstragg lglnlqsadt viifdsdwnp hqdlqaqdra hrigqgnevr 1201  vlrlctvnsv eekilaaaky klnvdqkviq agmfdqksss herraflqai leheeqdeee 1261  devpddetvn qmiarheeef dlfmrmdldr rreearnpkr kprlmeedel pswiikddae 1321  verltceeee ekmfgrgsrh rkevdysdsl tekqwlkaie egtleeieee vrqkkssrkr 1381  krdsdagsst pttstrsrdk ddeskkqkkr grppaeklsp nppnitkkmk kivdavikyk 1441  dsssgrqlse vfiqlpsrke lpeyyelirk pvdfkkiker irnhkyrsln dlekdvmllc 1501  gnagtfnleg sliyedsivl qsvftsvrqk iekeddsege eseeeegee egsesesrsv 1561  kvkiklgrke kaqdrlkggr rrpsrgsrak pvvsddddsee eqeedrsgsg seed
```

SEQ ID NO: 64 Human BRG1 cDNA Sequence Variant 7 (NM_001128848.1, CDS: from 1 to 4842)

```
   1  atgtccactc cagacccacc cctgggcgga actcctcggc caggtccttc cccgggccct 61  ggcccttccc ctggagccat gctgggccct agcccgggtc cctgccgggg ctccgcccac 121  agcatgatgg ggcccagccc agggccgccc tcagcaggac accccatccc cacccagggg 181  cctggagggt accctcagga caacatgcac cagatgcaca gcccatgga gtccatgcat 241  gagaagggca tgtcggacga cccgcgctac aaccagatga aggaatggg gatgcggtca
```

TABLE 1-continued

```
 301  gggggccatg ctgggatggg gcccccgccc agccccatgg accagcactc ccaaggttac
 361  ccctcgcccc tgggtggctc tgagcatgcc tctagtccag ttccagccag tgcccgtct
 421  tcggggcccc agatgtcttc cgggccagga ggtgccccgc tggatggtgc tgaccccag
 481  gccttggggc agcagaaccg gggcccaacc ccatttaacc agaaccagct gcaccagctc
 541  agagctcaga tcatggccta caagatgctg gccaggggc agcccctccc cgaccacctg
 601  cagatggcgg tgcagggcaa gcggccgatg cccgggatgc agcagcagat gccaacgcta
 661  cctccaccct cggtgtccgc aacaggaccc ggccctggcc ctggccctgg ccccggcccg
 721  ggtcccggcc cggcacctcc aaattacagc aggcctcatg gtatgggagg cccaacatg
 781  cctcccccag accctcgggg cgtgcccccc gggatgccag gccagcctcc tggagggcct
 841  cccaagccct ggcctgaagg acccatggcg aatgctgctg cccccacgag caccccctcag
 901  aagctgattc ccccgcagcc aacgggccgc ccttcccccg cgcccctgc cgtcccaccc
 961  gccgcctcgc ccgtgatgcc accgcagacc cagtccccg ggcagccggc ccagcccgcg
1021  cccatggtgc cactgcacca gaagcagagc cgcatcaccc ccatccagaa gccgcggggc
1081  ctcgaccctg tggagatcct gcaggagcgc gagtacaggc tgcaggctc catcgcacac
1141  cgaattcagg aacttgaaaa ccttcccggg tccctggccg gggatttgcg aaccaaagcg
1201  accattgagc tcaaggccct caggctgctg aacttccaga ggcagctgcg ccaggaggtg
1261  gtggtgtgca tgcggaggga cacagcgctg gagacagccc tcaatgctaa ggcctacaag
1321  cgcagcaagc gccagtccct gcgcgaggcc cgcatcactg agaagctgga gaagcagcag
1381  aagatcgagc aggagcgcaa gcgccggcag aagcaccagg aatacctcaa tagcattctc
1441  cagcatgcca aggatttcaa ggaatatcac agatccgtca caggcaaaat ccagaagctg
1501  accaaggcag tggccacgta ccatgccaac acggagcggg agcagaagaa agagaacgag
1561  cggatcgaga aggagcgcat gcggaggctc atggctgaag atgaggaggg gtaccgcaag
1621  ctcatcgacc agaagaagga caagcgcctg gcctacctct tgcagcagac agacgagtac
1681  gtggctaacc tcacggagct ggtgcggcag cacaaggctg cccaggtcgc caaggagaaa
1741  aagaagaaaa agaaaaagaa gaaggcagaa aatgcagaag acagacgcc tgccattggg
1801  ccggatggcg agcctctgga cgagaccagc cagatgagcg acctcccggt gaaggtgatc
1861  cacgtggaga gtgggaagat cctcacaggc acagatgccc caaagccgg gcagctggag
1921  gcctggctcg agatgaaccc gggggtatgaa gtagctccga ggtctgatag tgaagaaagt
1981  ggctcagaag aagaggaaga ggaggaggag gaagagcagc cgcaggcagc acagcctccc
2041  accctgcccg tggaggagaa gaagaagatt ccagatccag acagcgatga cgtctctgag
2101  gtgacgcgc ggcacatcat tgagaatgcc aagcaagatg tcgatgatga atatggcgtg
2161  tcccaggccc ttgcacgtgg cctgcagtcc tactatgccg tggcccatgc tgtcactgag
2221  agagtggaca gcagtcagc gcttatggtc aatggtgtcc tcaaacagta ccagatcaaa
2281  ggtttggagt ggctggtgtc cctgtacaac aacaacctga acggcatcct ggccgacgag
2341  atgggcctgg gaagaccat ccagaccatc gcgctcatca cgtacctcat ggagcacaaa
2401  cgcatcaatg gcccttcct catcatcgtg cctctctcaa cgctgtccaa ctgggcgtac
2461  gagtttgaca gtgggcccc ctccgtggtg aaggtgtctt acaagggatc cccagcagca
2521  agacgggcct ttgtccccca gctccggagt gggaagttca acgtcttgct gacgacgtac
2581  gagtacatca tcaaagacaa gcacatcctc gccaagatcc gttggaagta catgattgtg
2641  gacgaaggtc accgcatgaa gaaccaccac tgcaagctga cgcaggtgct caacacgcac
```

TABLE 1-continued

```
2701  tatgtggcac cccgccgcct gctgctgacg ggcacaccgc tgcagaacaa gcttcccgag
2761  ctctgggcgc tgctcaactt cctgctgccc accatcttca agagctgcag caccttcgag
2821  cagtggttta acgcacccct tgccatgacc ggggaaaagg tggacctgaa tgaggaggaa
2881  accattctca tcatccggcg tctccacaaa gtgctgcggc ccttcttgct ccgacgactc
2941  aagaaggaag tcgaggccca gttgcccgaa aaggtggagt acgtcatcaa gtgcgacatg
3001  tctgcgctgc agcgagtgct ctaccgccac atgcaggcca agggcgtgct gctgactgat
3061  ggctccgaga aggacaagaa gggcaaaggc ggcaccaaga ccctgatgaa caccatcatg
3121  cagctgcgga agatctgcaa ccacccctac atgttccagc acatcgagga gtccttttcc
3181  gagcacttgg ggttcactgg cggcattgtc caagggctgg acctgtaccg agcctcgggt
3241  aaatttgagc ttcttgatag aattcttccc aaactccgag caaccaacca caaagtgctg
3301  ctgttctgcc aaatgacctc cctcatgacc atcatggaag attactttgc gtatcgcggc
3361  tttaaatacc tcaggcttga tggaaccacg aaggcggagg accggggcat gctgctgaaa
3421  accttcaacg agcccggctc tgagtacttc atcttcctgc tcagcacccg ggctgggggg
3481  ctcggcctga acctccagtc ggcagacact gtgatcattt ttgacagcga ctggaatcct
3541  caccaggacc tgcaagcgca ggaccgagcc caccgcatcg ggcagcagaa cgaggtgcgt
3601  gtgctccgcc tctgcaccgt caacagcgtg gaggagaaga tcctagctgc agccaagtac
3661  aagctcaacg tggaccagaa ggtgatccag gccggcatgt cgaccagaa gtcctccagc
3721  catgagcggc gcgccttcct gcaggccatc ctggagcacg aggagcagga tgaggaggaa
3781  gacgaggtgc ccgacgacga gaccgtcaac cagatgatcg cccggcacga ggaggagttt
3841  gatctgttca tgcgcatgga cctggaccgc aggcgcgagg aggcccgcaa ccccaagcgg
3901  aagccgcgcc tcatggagga ggacgagctc ccctcgtgga tcatcaagga cgacgcggag
3961  gtggagcggc tgacctgtga ggaggaggag gagaagatgt tcggccgtgg ctcccgccac
4021  cgcaaggagg tggactacag cgactcactg acggagaagc agtggctcaa ggccatcgag
4081  gagggcacgc tggaggagat cgaagaggag gtccggcaga agaaatcatc acggaagcgc
4141  aagcgagaca cgcacgccgg ctcctccacc ccgaccacca gcaccgcag ccgcgacaag
4201  gacgacgaga gcaagaagca gaagaagcgc gggcggccgc ctgccgagaa actctcccct
4261  aacccaccca acctcaccaa gaagatgaag aagattgtgg atgccgtgat caagtacaag
4321  gacagcagtg gacgtcagct cagcgaggtc ttcatccagc tgcccgcg aaaggagctg
4381  cccgagtact acgagctcat ccgcaagccc gtggacttca gaagataaa ggagcgcatt
4441  cgcaaccaca gtaccgcag cctcaacgac ctagagaagg acgtcatgct cctgtgccag
4501  aacgcacaga ccttcaacct ggagggctcc ctgatctatg aagactccat cgtcttgcag
4561  tcggtcttca ccagcgtgcg gcagaaaatc gagaaggagg atgacagtga aggcgaggag
4621  agtgaggagg aggaagaggg cgaggaggaa ggctccgaat ccgaatctcg gtccgtcaaa
4681  gtgaagatca agcttggccg gaaggagaag gcacaggacc ggctgaaggg cggccggcgg
4741  cggccgagcc gagggtcccg agccaagccg gtcgtgagtg acgatgacag tgaggaggaa
4801  caagaggagg accgctcagg aagtggcagc gaagaagact gagccccgac attccagtct
4861  cgaccccgag cccctcgttc cagagctgag atggcatagg ccttagcagt aacgggtagc
4921  agcagatgta gtttcagact tggagtaaaa ctgtataaac aaaagaatct tccatattta
4981  tacagcagag aagctgtagg actgtttgtg actggccctg tcctggcatc agtagcatct
5041  gtaacagcat taactgtctt aaagagagag agagagaatt ccgaattggg gaacacacga
```

| | |
|---|---|
| 5101 | tacctgtttt tcttttccgt tgctggcagt actgttgcgc cgcagtttgg agtcactgta |
| 5161 | gttaagtgtg gatgcatgtg cgtcaccgtc cactcctcct actgtatttt attggacagg |
| 5221 | tcagactcgc cgggggcccg gcgagggtat gtcagtgtca ctggatgtca aacagtaata |
| 5281 | aattaaacca acaacaaaac gcacagccaa aaaaaaa |

SEQ ID NO: 65 Human BRG1 Amino Acid Sequence Isoform F (NP_001122320.1)

| | |
|---|---|
| 1 | mstpdpplgg tprpgpspgp gpspgamlgp spgpspgsah smmgpspgpp saghpiptqg |
| 61 | pggypqdnmh qmhkpmesmh ekgmsddpry nqmkgmgmrs gghagmgppp spmdqhsqgy |
| 121 | psplggseha sspvpasgps sgpqmssgpg gapldgadpq algqqnrgpt pfnqnqlhql |
| 181 | ragimaykml argqplpdhl qmavqgkrpm pgmqqqmptl pppsysatgp gpgpgpgpgp |
| 241 | gpgpappnys rphgmggpnm pppgpsgvpp gmpgqppgp pkpwpegpma naaaptstpq |
| 301 | klippqptgr pspappavpp aaspvmppqt gspggpagpa pmvplhqkqs ritpiqkprg |
| 361 | ldpveilger eyrlgariah rigelenlpg slagdlrtka tielkalrll nfqrqlrgev |
| 421 | vvcmrrdtal etalnakayk rskrqslrea riteklekqg kiegerkrrq khqeylnsil |
| 481 | qhakdfkeyh rsvtgkiqkl tkavatyhan tereqkkene riekermrrl maedeegyrk |
| 541 | lidqkkdkrl ayllqqtdey vanitelvrq hkaaqvakek kkkkkkkae naegqtpaig |
| 601 | pdgepldets qmsdlpvkvi hvesgkiltg tdapkagqle awlemnpgye vaprsdsees |
| 661 | gseeeeeeee eeqpqaaqpp tlpveekkki pdpdsddvse vdarhiiena kqdvddeygv |
| 721 | sgalarglqs yyavahavte rvdkqsalmv ngvlkqyqik glewlvslyn nnlngilade |
| 781 | mglgktiqti alitylmehk ringpfliiv plstlnsnway efdkwapsvv kvsykgspaa |
| 841 | rrafvpqlrs gkfnvlltty eyiikdkhil akirwkymiv deghrmknhh ckltqvinth |
| 901 | yvaprrlllt gtplqnklpe lwallnfllp tifkscstfe qwfnapfamt gekvdlneee |
| 961 | tiliirrlhk vlrpfllrrl kkeveaqlpe kveyvikcdm salqrvlyrh mqakgvlltd |
| 1021 | gsekdkkgkg gtktlmntim qlrkicnhpy mfqhieeesfs ehlgftggiv qgldlyrasg |
| 1081 | kfelldrilp klratnhkvl lfcgmtslmt imedyfayrg fkylrldgtt kaedrgmllk |
| 1141 | tfnepgseyf ifllstragg lglnlqsadt viifdsdwnp hqdlqaqdra hrigqgnevr |
| 1201 | vlrlctvnsv eekilaaaky klnvdqkviq agmfdqksss herraflqai leheeqdeee |
| 1261 | devpddetvn qmiarheeef dlfmrmdldr rreearnpkr kprlmeedel pswiikddae |
| 1321 | verltceeee ekmfgrgsrh rkevdysdsl tekqwlkaie egtleeieee vrqkkssrkr |
| 1381 | krdsdagsst pttstrsrdk ddeskkqkkr grppaeklsp nppnitkkmk kivdavikyk |
| 1441 | dssgrqlsev fiqlpsrkel peyyelirkp vdfkkikeri rnhkyrslnd lekdvmllcq |
| 1501 | naqtfnlegs liyedsivlq svftsvrqki ekeddsegee seeeeegeee gsesesrsvk |
| 1561 | vkiklgrkek aqdrlkggrr rpsrgsrakp vvsdddseee qeedrsgsgs eed |

SEQ ID NO: 66 Mouse BRG1 cDNA Sequence Variant 1 (NM_001174078.1, CDS: from 261 to 5114)

| | |
|---|---|
| 1 | ggcaagtgga gcgggtagac agggaggcgg gggcgcgcgg cgggcgcgtg cggtgggggg |
| 61 | gggtggcctg gcgaagccca gcggggcgcgc gcgcgaggct ttcccactcg cttggcagcg |
| 121 | gcggagacgg cttctttgtt tcctgaggag aagcgagacg cccactctgt ccccgacccc |
| 181 | tcgtggaggg ttggggggcgg cgccaggaag gttacggcgc cgttacctcc aggagaccag |
| 241 | tgcctgtagc tccagtaaag atgtctactc cagacccacc cttgggtggg actcctcggc |
| 301 | ctggtccttc cccaggccct ggtccttcac ctggtgcaat gctgggtcct agccctggcc |
| 361 | cctcaccagg ttctgcccac agcatgatgg ggccaagccc aggacctcct tcagcaggac |
| 421 | atcccatgcc cacccagggg cctggagggt accccagga caacatgcat cagatgcaca |

TABLE 1-continued

```
 481 agcctatgga gtccatgcac gagaagggca tgcctgatga cccacgatac aaccagatga
 541 aagggatggg catgcggtca ggggcccaca caggcatggc acctccacct agtcccatgg
 601 accagcattc tcaaggttac ccctcacccc tcggcggctc tgaacatgcc tccagtcctg
 661 tcccagccag tggcccatct tcaggccccc agatgtcctc tgggccagga ggggccccac
 721 tagatggttc tgatccccag gccttgggac agcaaaacag aggcccaacc ccatttaacc
 781 agaaccagct gcatcaactc agagctcaga taatggccta caagatgttg gccaggggcc
 841 agccattgcc cgaccacctg cagatggccg tgcaaggcaa gcggccgatg cctggaatgc
 901 agcaacagat gccaacacta cctccaccct cagtgtccgc cacaggaccc ggacctggac
 961 ccggccctgg ccctggccct ggcccaggac cagcccctcc aaattacagt agacccatg
1021 gtatgggagg gcccaacatg cctcccccag gaccctcagg tgtgcccccc gggatgcctg
1081 gtcagccgcc tggagggcct cccaagccat ggcctgaagg acccatggcc aatgctgctg
1141 cccccacaag caccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctgaa gcctggcttg aaatgaaccc agggtatgaa gtagccccca
2221 ggtcagacag tgaagaaagt ggctctgaag aggaggagga ggaggaggaa gaggagcagc
2281 ctcagcccgc acagccccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata agcagtccgc cctcatggtc aacggtgtcc
2521 tcaaacagta ccagatcaag ggtttggagt ggctggtgtc cctgtacaac aacaacctga
2581 atggcatcct ggctgatgag atggggctgg ggaagaccat ccagaccatc gcgctcatca
2641 catcctcat ggagcacaag cgcatcaacg gccttttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgtcccaca gcttcgcagt gggaagttca
2821 acgtcttact gaccaccctat gaatatatca tcaaagacaa gcatatccta gccaagatcc
```

TABLE 1-continued

```
2881  gctggaagta catgattgtg gatgaaggcc accgcatgaa aaaccaccac tgcaagttga
2941  cgcaggtcct taacacacac tacgtggccc ctcggcgcct gcttcttaca ggcacaccac
3001  tgcagaacaa gctaccggag ctctgggccc tgcttaactt cctgctcccc actatcttca
3061  agagctgcag caccttcgaa cagtggttca atgcaccctt tgccatgact ggagaaaagg
3121  tggacctgaa tgaagaggag actatcctca ttattcgtcg cctacacaaa gttctgcggc
3181  ccttcctgct gcggcggctc aagaaggaag ttgaagccca gctccctgag aaggtagagt
3241  atgtcatcaa atgcgacatg tcagccctgc agcgtgtgct gtaccgtcac atgcaggcca
3301  aaggtgtgct gctgactgac ggctccgaga aggacaagaa gggcaaaggt ggcaccaaga
3361  cactgatgaa cactattatg caactgcgta agatctgcaa ccacccctac atgttccagc
3421  acatcgagga gtcctttttct gagcacttgg ggttcaccgg cggcatcgtg caaggattgg
3481  acctttaccg tgcctcaggg aaatttgaac ttcttgatag aattctaccc aaactccgtg
3541  caacgaacca taaagtgctc ctcttttgcc aaatgacctc cctcatgacc atcatggaag
3601  actactttgc ataccgtggc ttcaaatacc tcaggcttga tggaaccaca aaagcagaag
3661  accggggcat gctgttgaaa acctttaatg aacctggctc tgagtatttc attttcctgc
3721  tcagtacccg tgctgggggg ctgggcctga atctgcagtc agctgacact gtgatcatct
3781  ttgacagtga ctggaatccc caccaggacc tgcaagcaca ggatcgagcc catcgcattg
3841  gacagcagaa tgaggtgcgt gttcttcgcc tgtgcacggt caacagtgtg aagagaaga
3901  tactggctgc tgccaaatac aaactcaatg tggatcagaa ggtgatccag gcaggcatgt
3961  tcgaccagaa gtcgtccagc catgagaggc gtgccttcct gcaggccatc ctggagcacg
4021  aggagcagga tgaggaggaa gatgaggtgc ctgatgatga gaccgtcaac cagatgattg
4081  cccggcacga agaagagttt gacctcttca tgcgcatgga cttggaccgc cggcgtgaag
4141  aagcccgcaa ccccaagcgg aagccacgcc tgatggaaga ggatgagctc ccatcctgga
4201  tcatcaagga tgatgccgag gtggagcggc tgacatgtga agaggaagag gagaagatgt
4261  tcggccgtgg ttctcgccac cgcaaggagg tagactacag cgactcactg acagagaagc
4321  agtggctcaa gaccctgaag gctatcgagg agggcacgct ggaggagatc gaagaggagg
4381  tccggcagaa gaaatcttca cgtaagcgta agcgagacag cgaggccggc tcctccaccc
4441  cgaccaccag caccgcagc cgtgacaagg atgaggagag caagaagcag aagaaacgtg
4501  ggcggccacc tgctgagaag ctgtccccaa acccacctaa cctcaccaag aagatgaaga
4561  agatcgtgga tgctgtgatc aagtacaaag acagcagcag tggacgtcag ctcagcgagg
4621  tgttcatcca gctcccctct cgcaaggagc ttcctgagta ctatgagctc atccgaaagc
4681  ctgtggactt caagaagatc aaggaacgca tccgaaacca cagtaccgc agcctcaatg
4741  acctggagaa ggatgtgatg ctgctgtgcc agaacgctca gacgttcaac ctcgagggtt
4801  ccctgatcta tgaggactcc atcgtcctgc agtctgtctt caccagcgta cggcagaaga
4861  ttgagaagga ggacgacagt gaaggcgagg aaagcgagga ggaggaggag ggcgaggagg
4921  aaggctccga gtctgagtcc cgctccgtca aggtgaagat caagctgggc cgcaaggaga
4981  aggcccagga ccgactcaag ggggccgcc ggcggccaag ccggggatcc cgggccaagc
5041  cggttgtgag tgacgatgac agtgaggagg agcaggagga ggaccgctca ggaagtggca
5101  gtgaggaaga ctgaaccaga cattcctgag tcctgacccc gaggcgctcg tcccagccaa
5161  gatggagtag cccttagcag tgatgggtag caccagatgt agtttcgaac ttgagaact
5221  gtacacatgc aatcttccac attttttaggc agagaagtat aggcctgtct gtcggccctg
```

TABLE 1-continued

```
5281  gcctggcctc gagtctctac cagcattaac tgtctagaga ggggaccctcc tgggagcacc
5341  atccacctcc ccaggcccca gtcactgtag ctcagtggat gcatgcgcgt gccggccgct
5401  ccttgtactg tatcttactg gacagggcca gctctccagg aggctcacag gcccagcggg
5461  tatgtcagtg tcactggagt cagacagtaa taaattaaag caatgacaag ccaccactgg
5521  ctccctggac tccttgctgt cagcagtggc tccggggcca cagagaagaa agaaagactt
5581  ttaggaactg ggtctaactt atgggcaaag tacttgcctt gccaggtgta tgggttttgc
5641  attcccatca cccacacacc ctaaacaagc caagtcagtg agcttcaagt tagagcctcc
5701  acctcaatgt gtacgtggaa agcaatcaaa gatgatgcct agcatccacc tctggccctc
5761  atgtgcagat gtacacacac tgaattacat acacgggaca cacacatcca cacggaggca
5821  gtccatgact tgcactgggg agatggtacc ataggcgaaa gtgccacagg cacagggcca
5881  ggctaattta gtcctgcagt cctgtgctct taagatgaag gcacaaagag gaacccccagg
5941  cgctccaact agcatgccag gcagtgacaa gaccctgctt caaatgaatc agagcccaca
6001  ttcagtattg ccctcttacc cgatgcgatg cccatgccct cacatatgaa tgtgtatata
6061  tacatacata cgtaaaaataa ttcttttta aattatagac attttttgtgt gaatgttttg
6121  cctgaatgtg tgtgtgtgtg tgtgtgtgtg tgtgtgtgtg tgtgtgtgtg tatcaagtac
6181  attcctagag cctacagagg tcagggagg gcattggatc tggaactgga gtcacatgag
6241  gctgtgagca actgtgtggg ttcctgggcc tttgcaacag cagttagtac tcttcaccac
6301  tgagccattt ctccaatctc aaaagaagc attcttttaa atgaagactg aaataaataa
6361  gtaggacttg ccttgg
```

SEQ ID NO: 67 Mouse BRG1 Amino Acid Sequence Isoform A (NP_001167549.1)
```
   1  mstpdpplgg tprpgpspgp gpspgamlgp spgpspgsah smmgpspgpp saghpmptqg
  61  pggypqdnmh qmhkpmesmh ekgmpddpry nqmkgmgmrs gahtgmappp spmdqhsqgy
 121  psplggseha sspvpasgps sgpqmssgpg gapldgsdpq algqqnrgpt pfnqnqlhql
 181  ragimaykml argqplpdhl qmavqgkrpm pgmqqqmptl pppsysatgp gpgpgpgpgp
 241  gpgpappnys rphgmggpnm pppgpsgvpp gmpgqppgqp pkpwpegpma naaaptstpq
 301  klippqqptgr pspappavpp aaspvmppqt gspggpagpa plvplhqkqs ritpiqkprg
 361  ldpveilger eyrlgariah rigelenlpg slagdlrtka tielkalrll nfqrqlrgev
 421  vvcmrrdtal etalnakayk rskrqslrea riteklekqg kiegerkrrq khqeylnsil
 481  qhakdfreyh rsvtgklqkl tkavatyhan tereqkkene riekermrrl maedeegyrk
 541  lidqkkdkrl ayllqqtdey vanitelvrq hkaaqvakek kkkkkkkae naegqtpaig
 601  pdgepldets qmsdlpvkvi hvesgkiltg tdapkagqle awlemnpgye vaprsdsees
 661  gseeeeeeee eeqpqpaqpp tlpveekkki pdpdsddvse vdarhiiena kqdvddeygv
 721  sgalarglqs yyavahavte rvdkqsalmv ngvlkqyqik glewlvslyn nnlngilade
 781  mglgktiqti alitylmehk ringpfliiv plstlsnway efdkwapsvv kvsykgspaa
 841  rrafvpqlrs gkfnvllty eyiikdkhil akirwkymiv deghrmknhh ckltqvinth
 901  yvaprrlllt gtplqnklpe lwallnfllp tifkscstfe qwfnapfamt gekvdlneee
 961  tiliirrlhk vlrpfllrrl kkeveaqlpe kveyvikcdm salqrvlyrh mqakgvlltd
1021  gsekdkkgkg gtktlmntim qlrkicnhpy mfqhieeesfs ehlgftggiv qgldlyrasg
1081  kfelldrilp klratnhkvl lfcgmtslmt imedyfayrg fkylrldgtt kaedrgmllk
1141  tfnepgseyf iflllstragg lglnlqsadt viifdsdwnp hqdlqaqdra hrigqgnevr
1201  vlrlctvnsv eekilaaaky klnvdqkviq agmfdqksss herraflqai leheeqdeee
```

TABLE 1-continued

```
1261 devpddetvn qmiarheeef dlfmrmdldr rreearnpkr kprlmeedel pswiikddae
1321 verltceeee ekmfgrgsrh rkevdysdsl tekqwlktlk aieegtleei eeevrqkkss
1381 rkrkrdseag sstpttstrs rdkdeeskkq kkrgrppaek lspnppnitk kmkkivdavi
1441 kykdsssgrq lsevfiqlps rkelpeyyel irkpvdfkki kerirnhkyr slndlekdvm
1501 llcgnagtfn legsliyeds ivlqsvftsv rqkiekedds egeeseeeee geeegseses
1561 rsvkvkiklg rkekaqdrlk ggrrrpsrgs rakpvvsddd seeeqeedrs gsgseed
```

SEQ ID NO: 68 Mouse BRG1 cDNA Sequence Variant 2 (NM_011417.3, CDS: from 261 to 5105)

```
   1 ggcaagtgga gcgggtagac agggaggcgg gggcgcgcgg cgggcgcgtg cggtgggggg
  61 gggtggcctg gcgaagccca gcgggcgcgc gcgcgaggct ttcccactcg cttggcagcg
 121 gcggagacgg cttctttgtt tcctgaggag aagcgagacg cccactctgt ccccgacccc
 181 tcgtggaggg ttgggggcgg cgccaggaag gttacggcgc cgttacctcc aggagaccag
 241 tgcctgtagc tccagtaaag atgtctactc cagacccacc cttgggtggg actcctcggc
 301 ctggtccttc cccaggccct ggtccttcac ctggtgcaat gctgggtcct agccctggcc
 361 cctcaccagg ttctgcccac agcatgatgg ggccaagccc aggacctcct tcagcaggac
 421 atcccatgcc cacccagggg cctggagggt accccaggga caacatgcat cagatgcaca
 481 agcctatgga gtccatgcac gagaagggca tgcctgatga cccacgatac aaccagatga
 541 aagggatggg catgcggtca ggggcccaca caggcatggc cctccacct agtcccatgg
 601 accagcattc tcaaggttac ccctcacccc tcggcggctc tgaacatgcc tccagtcctg
 661 tcccagccag tggcccatct tcaggccccc agatgtcctc tgggccagga ggggcccac
 721 tagatggttc tgatcccag gccttgggac agcaaaacag aggcccaacc ccatttaacc
 781 agaaccagct gcatcaactc agagctcaga taatggccta caagatgttg gccaggggcc
 841 agccattgcc cgaccacctg cagatggccg tgcaaggcaa gcggccgatg cctggaatgc
 901 agcaacagat gccaacacta cctccaccct cagtgtccgc acaggaccc ggacctggac
 961 ccggccctgg ccctggccct ggcccaggac cagcccctcc aaattacagt agaccccatg
1021 gtatgggagg gcccaacatg cctcccccag daccctcagg tgtgcccccc gggatgcctg
1081 gtcagccgcc tggagggcct cccaagccat ggcctgaagg acccatggcc aatgctgctg
1141 cccccacaag caccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
```

TABLE 1-continued

```
1981  cccaggttgc caaggagaag aagaagaaaa agaaaaagaa gaaggcagaa aatgctgaag
2041  gacagacacc tgctattgga ccagatggtg agcctctgga tgagaccagc cagatgagtg
2101  acctccctgt gaaggtgatc cacgtggaga gtggcaagat cctcactggc acagatgccc
2161  caaaagccgg gcagctgaaa gcctggcttg aaatgaaccc agggtatgaa gtagccccca
2221  ggtcagacag tgaagaaagt ggctctgaag aggaggagga ggaggaggaa gaggagcagc
2281  ctcagcccgc acagccccct acactgcctg tggaagaaaa gaagaagatt ccagacccag
2341  acagcgatga tgtctctgag gtggacgccc gacacattat tgagaacgcc aagcaagatg
2401  tggacgatga gtacggtgtg tcccaggccc ttgctcgtgg cctgcagtct tactatgctg
2461  tggcccatgc agtcacagag agagtagata agcagtccgc cctcatggtc aacggtgtcc
2521  tcaaacagta ccagatcaag ggtttggagt ggctggtgtc cctgtacaac aacaacctga
2581  atggcatcct ggctgatgag atggggctgg ggaagaccat ccagaccatc gcgctcatca
2641  catacctcat ggagcacaag cgcatcaacg gccttttcct catcatcgtg cctctctcga
2701  cactgtcaaa ctgggcgtat gaatttgaca agtgggcccc ctctgtggtg aaggtttctt
2761  acaagggctc tccagctgca aggcgagctt ttgtcccaca gcttcgcagt gggaagttca
2821  acgtcttact gaccacctat gaatatatca tcaaagacaa gcatatccta gccaagatcc
2881  gctggaagta catgattgtg gatgaaggcc accgcatgaa aaaccaccac tgcaagttga
2941  cgcaggtcct taacacacac tacgtggccc ctcggcgcct gcttcttaca ggcacaccac
3001  tgcagaacaa gctaccggag ctctgggccc tgcttaactt cctgctcccc actatcttca
3061  agagctgcag caccttcgaa cagtggttca atgcaccctt tgccatgact ggagaaaagg
3121  tggacctgaa tgaagaggag actatcctca ttattcgtcg cctacacaaa gttctgcggc
3181  ccttcctgct gcggcggctc aagaaggaag ttgaagccca gctccctgag aaggtagagt
3241  atgtcatcaa atgcgacatg tcagccctgc agcgtgtgct gtaccgtcac atgcaggcca
3301  aaggtgtgct gctgactgac ggctccgaga aggacaagaa gggcaaaggt ggcaccaaga
3361  cactgatgaa cactattatg caactgcgta agatctgcaa ccaccccctac atgttccagc
3421  acatcgagga gtccttttct gagcacttgg ggttcaccgg cggcatcgtg caaggattgg
3481  acctttaccg tgcctcaggg aaatttgaac ttcttgatag aattctaccc aaactccgtg
3541  caacgaacca taaagtgctc ctcttttgcc aaatgacctc cctcatgacc atcatggaag
3601  actactttgc ataccgtggc ttcaaatacc tcaggcttga tggaaccaca aaagcagaag
3661  accggggcat gctgttgaaa acctttaatg aacctggctc tgagtatttc attttcctgc
3721  tcagtacccg tgctgggggg ctgggcctga atctgcagtc agctgacact gtgatcatct
3781  ttgacagtga ctggaatccc caccaggacc tgcaagcaca ggatcgagcc atcgcattg
3841  gacagcagaa tgaggtgcgt gttcttcgcc tgtgcacggt caacagtgtg aagagaaga
3901  tactggctgc tgccaaatac aaactcaatg tggatcagaa ggtgatccag gcaggcatgt
3961  tcgaccagaa gtcgtccagc catgagaggc gtgccttcct gcaggccatc ctggagcacg
4021  aggagcagga tgaggaggaa gatgaggtgc ctgatgatga accgtcaac cagatgattg
4081  cccggcacga agaagagttt gacctcttca tgcgcatgga cttgaccgc cggcgtgaag
4141  aagcccgcaa ccccaagcgg aagccacgcc tgatggaaga ggatgagctc ccatcctgga
4201  tcatcaagga tgatgccgag gtggagcggc tgacatgtga agaggaagag gagaagatgt
4261  tcggccgtgg ttctcgccac cgcaaggagg tagactacag cgactcactg acagagaagc
4321  agtggctcaa ggctatcgag gagggcacgc tggaggagat cgaagaggag gtccggcaga
```

TABLE 1-continued

```
4381  agaaatcttc acgtaagcgt aagcgagaca gcgaggccgg ctcctccacc ccgaccacca
4441  gcacccgcag ccgtgacaag gatgaggaga gcaagaagca gaagaaacgt gggcggccac
4501  ctgctgagaa gctgtcccca aacccaccta acctcaccaa gaagatgaag aagatcgtgg
4561  atgctgtgat caagtacaaa gacagcagca gtggacgtca gctcagcgag gtgttcatcc
4621  agctcccctc tcgcaaggag cttcctgagt actatgagct catccgaaag cctgtggact
4681  tcaagaagat caaggaacgc atccgaaacc acaagtaccg cagcctcaat gacctggaga
4741  aggatgtgat gctgctgtgc cagaacgctc agacgttcaa cctcgagggt tccctgatct
4801  atgaggactc catcgtcctg cagtctgtct tcaccagcgt acggcagaag attgagaagg
4861  aggacgacag tgaaggcgag gaaagcgagg aggaggagga gggcgaggag gaaggctccg
4921  agtctgagtc ccgctccgtc aaggtgaaga tcaagctggg ccgcaaggag aaggcccagg
4981  accgactcaa ggggggccgc cggcggccaa gccggggatc ccgggccaag ccggttgtga
5041  gtgacgatga cagtgaggag gagcaggagg aggaccgctc aggaagtggc agtgaggaag
5101  actgaaccag acattcctga gtcctgaccc cgaggcgctc gtcccagcca agatggagta
5161  gcccttagca gtgatgggta gcaccagatg tagtttcgaa cttggagaac tgtacacatg
5221  caatcttcca cattttttagg cagagaagta taggcctgtc tgtcggccct ggcctggcct
5281  cgagtctcta ccagcattaa ctgtctagag aggggacctc ctgggagcac catccacctc
5341  cccaggcccc agtcactgta gctcagtgga tgcatgcgcg tgccggccgc tccttgtact
5401  gtatcttact ggacagggcc agctctccag gaggctcaca ggcccagcgg tatgtcagt
5461  gtcactggag tcagacagta ataaattaaa gcaatgacaa gccaccactg gctccctgga
5521  ctccttgctg tcagcagtgg ctccggggcc acagagaaga aagaaagact tttaggaact
5581  gggtctaact tatgggcaaa gtacttgcct tgccaggtgt atgggttttg cattcccatc
5641  acccacacac cctaaacaag ccaagtcagt gagcttcaag ttagagcctc cacctcaatg
5701  tgtacgtgga aagcaatcaa agatgatgcc tagcatccac ctctggccct catgtgcaga
5761  tgtacacaca ctgaattaca tacacgggac acacacatcc acacggaggc agtccatgac
5821  ttgcactggg gagatggtac cataggcgaa agtgccacag gcacagggcc aggctaattt
5881  agtcctgcag tcctgtgctc ttaagatgaa ggcacaaaga ggaaccccag gcgctccaac
5941  tagcatgcca ggcagtgaca agaccctgct tcaaatgaat cagagcccac attcagtatt
6001  gccctcttac ccgatgcgat gcccatgccc tcacatatga atgtgtatat atacatacat
6061  acgtaaaata attctttttt aaattataga cattttttgtg tgaatgtttt gcctgaatgt
6121  gtgtgtgtgt gtgtgtgtgt gtgtgtgtgt gtgtgtgtgt gtatcaagta cattcctaga
6181  gcctacagag gtcaaggag ggcattggat ctggaactgg agtcacatga ggctgtgagc
6241  aactgtgtgg gttcctgggc ctttgcaaca gcagttagta ctcttcacca ctgagccatt
6301  tctccaatct caaaagaag cattcttttta aatgaagact gaaataaata agtaggactt
6361  gccttgg
```

SEQ ID NO: 69 Mouse BRG1 Amino Acid Sequence Isoform B (NP_035547.2)

```
  1  mstpdpplgg tprpgpspgp gpspgamlgp spgpspgsah smmgpspgpp saghpmptqg
 61  pggypqdnmh qmhkpmesmh ekgmpddpry nqmkgmgmrs gahtgmappp spmdqhsqgy
121  psplggseha sspvpasgps sgpqmssgpg gapldgsdpq algqqnrgpt pfnqnqlhql
181  ragimaykml argqplpdhl qmavqgkrpm pgmqqqmptl pppsysatgp gpgpgpgpgp
241  gpgpappnys rphgmggpnm pppgpsgvpp gmpgqppggp pkpwpegpma naaaptstpq
301  klippqpqtgr pspappavpp aaspvmppqt gspggpagpa plvplhqkqs ritpiqkprg
```

TABLE 1-continued

```
 361  ldpveilger eyrlgariah rigelenlpg slagdlrtka tielkalrll nfqrqlrgev
 421  vvcmrrdtal etalnakayk rskrqslrea riteklekqg kiegerkrrq khqeylnsil
 481  qhakdfreyh rsvtgklqkl tkavatyhan tereqkkene riekermrrl maedeegyrk
 541  lidqkkdkrl ayllqqtdey vanitelvrq hkaaqvakek kkkkkkkae naegqtpaig
 601  pdgepldets qmsdlpvkvi hvesgkiltg tdapkagqle awlemnpgye vaprsdsees
 661  gseeeeeeee eeqpqpaqpp tlpveekkki pdpdsddvse vdarhiiena kqdvddeygv
 721  sgalarglqs yyavahavte rvdkqsalmv ngvlkqyqik glewlvslyn nnlngilade
 781  mglgktiqti alitylmehk ringpfliiv plstlsnway efdkwapsvv kvsykgspaa
 841  rrafvpqlrs gkfnvlltty eyiikdkhil akirwkymiv deghrmknhh ckltqvinth
 901  yvaprrlllt gtplqnklpe lwallnfllp tifkscstfe qwfnapfamt gekvdlneee
 961  tiliirrlhk vlrpfllrrl kkeveaqlpe kveyvikcdm salqrvlyrh mqakgvlltd
1021  gsekdkkgkg gtktlmntim qlrkicnhpy mfqhieeesfs ehlgftggiv qgldlyrasg
1081  kfelldrilp klratnhkvl lfcgmtslmt imedyfayrg fkylrldgtt kaedrgmllk
1141  tfnepgseyf ifllstragg lglnlqsadt viifdsdwnp hqdlqaqdra hrigqgnevr
1201  vlrlctvnsv eekilaaaky klnvdqkviq agmfdqksss herraflqai leheeqdeee
1261  devpddetvn qmiarheeef dlfmrmdldr rreearnpkr kprlmeedel pswiikddae
1321  verltceeee ekmfgrgsrh rkevdysdsl tekqwlkaie egtleeieee vrqkkssrkr
1381  krdseagsst pttstrsrdk deeskkqkkr grppaeklsp nppnitkkmk kivdavikyk
1441  dsssgrqlse vfiqlpsrke lpeyyelirk pvdfkkiker irnhkyrsln dlekdvmllc
1501  gnagtfnleg sliyedsivl qsvftsvrqk iekeddsege eseeeeegee egsesesrsv
1561  kvkiklgrke kaqdrlkggr rrpsrgsrak pvvsdddsee eqeedrsgsg seed
```

SEQ ID NO: 70 Mouse BRG1 cDNA Sequence Variant 3 (NM_001174079.1, CDS: from 261 to 5102)

```
   1  ggcaagtgga gcgggtagac agggaggcgg gggcgcgcgg cgggcgcgtg cggtgggggg
  61  gggtggcctg gcgaagccca gcgggcgcgc gcgcgaggct ttcccactcg cttggcagcg
 121  gcggagacgg cttctttgtt tcctgaggag aagcgagacg cccactctgt ccccgacccc
 181  tcgtggaggg ttgggggcgg cgccaggaag gttacggcgc cgttacctcc aggagaccag
 241  tgcctgtagc tccagtaaag atgtctactc cagacccacc cttgggtggg actcctcggc
 301  ctggtccttc cccaggccct ggtccttcac ctggtgcaat gctgggtcct agccctggcc
 361  cctcaccagg ttctgcccac agcatgatgg ggccaagccc aggacctcct tcagcaggac
 421  atcccatgcc cacccagggg cctggagggt accccaggga caacatgcat cagatgcaca
 481  agcctatgga gtccatgcac gagaagggca tgcctgatga cccacgatac aaccagatga
 541  aagggatggg catgcggtca ggggcccaca caggcatggc acctccacct agtcccatgg
 601  accagcattc tcaaggttac ccctcacccc tcggcggctc tgaacatgcc tccagtcctg
 661  tcccagccag tggcccatct tcaggccccc agatgtcctc tgggccagga ggggccccac
 721  tagatggttc tgatcccag gccttgggac agcaaaacag aggcccaacc ccatttaacc
 781  agaaccagct gcatcaactc agagctcaga taatggccta caagatgttg gccaggggcc
 841  agccattgcc cgaccacctg cagatggccg tgcaaggcaa gcggccgatg cctggaatgc
 901  agcaacagat gccaacacta cctccaccct cagtgtccgc cacaggaccc ggacctggac
 961  ccggccctgg ccctggccct ggccaggac cagcccctcc aaattacagt agacccatg
1021  gtatgggagg gcccaacatg cctcccccag accctcagg tgtgccccc gggatgcctg
```

TABLE 1-continued

```
1081  gtcagccgcc tggagggcct cccaagccat ggcctgaagg acccatggcc aatgctgctg
1141  cccccacaag cacccccacag aagctgattc ctccgcaacc aacaggccgt ccttcacctg
1201  cacctcctgc tgtcccgcct gctgcctcac ctgtaatgcc accacaaaca cagtccccag
1261  ggcagccagc ccagcctgct ccattggtgc cactgcacca gaagcagagc cgaatcaccc
1321  ccatccagaa gccccgaggc cttgaccctg tggagatcct acaagagcgg gagtacaggc
1381  ttcaggctcg aatcgcacac agaattcagg aacttgaaaa cctccctggg tccctggctg
1441  gggaccttcg aaccaaagca accatcgaac tcaaggccct taggttgctg aacttccaga
1501  ggcagctgcg ccaggaggtg gtggtgtgca tgcgaagaga cacagccctg gagacagccc
1561  tcaatgccaa ggcctacaag cgcagcaaac gtcagtcact acgggaggcc cgcatcactg
1621  agaagttgga gaagcagcag aagattgaac aggagcgcaa cgccgccag aagcaccagg
1681  agtacctcaa cagcattctg cagcatgcca aggacttcag ggagtatcac agatcagtca
1741  caggcaaact ccagaaactc accaaggctg tggccaccta ccatgccaac actgagcggg
1801  agcagaagaa agaaaatgag cgcattgaga aggagcgaat gcggaggctt atggctgaag
1861  atgaggaggg ctaccgcaaa ctcattgacc agaagaagga caagcgcctg cctaccttc
1921  tgcagcagac agatgagtat gtggccaacc tcacagagct ggtgcggcag cacaaagctg
1981  cccaggttgc caaggagaag aagaagaaaa agaaaaagaa gaaggcagaa aatgctgaag
2041  gacagacacc tgctattgga ccagatggtg agcctctgga tgagaccagc cagatgagtg
2101  acctccctgt gaaggtgatc cacgtgagaa gtggcaagat cctcactggc acagatgccc
2161  caaaagccgg gcagctggaa gcctggcttg aaatgaaccc agggtatgaa gtagccccca
2221  ggtcagacag tgaagaaagt ggctctgaag aggaggagga ggaggaggaa gaggagcagc
2281  ctcagcccgc acagcccccct acactgcctg tggaagaaaa gaagaagatt ccagacccag
2341  acagcgatga tgtctctgag gtggacgccc gacacattat tgagaacgcc aagcaagatg
2401  tggacgatga gtacggtgtg tcccaggccc ttgctcgtgg cctgcagtct tactatgctg
2461  tggcccatgc agtcacagag agagtagata agcagtccgc cctcatggtc aacggtgtcc
2521  tcaaacagta ccagatcaag ggtttggagt ggctggtgtc cctgtacaac aacaacctga
2581  atggcatcct ggctgatgag atggggctgg ggaagaccat ccagaccatc gcgctcatca
2641  catacctcat ggagcacaag cgcatcaacg gccttttcct catcatcgtg cctctctcga
2701  cactgtcaaa ctgggcgtat gaatttgaca gtgggcccc ctctgtggtg aaggtttctt
2761  acaagggctc tccagctgca aggcgagctt ttgtcccaca gcttcgcagt gggaagttca
2821  acgtcttact gaccacctat gaatatatca tcaaagacaa gcatatccta gccaagatcc
2881  gctggaagta catgattgtg gatgaaggcc accgcatgaa aaaccaccac tgcaagttga
2941  cgcaggtcct taacacacac tacgtggccc ctcggcgcct gcttcttaca ggcacaccac
3001  tgcagaacaa gctaccggag ctctgggccc tgcttaactt cctgctcccc actatcttca
3061  agagctgcag caccttcgaa cagtggttca tgcaccctt tgccatgact ggagaaaagg
3121  tggacctgaa tgaagaggag actatcctca ttattcgtcg cctacacaaa gttctgcggc
3181  ccttcctgct gcggcggctc aagaaggaag ttgaagccca gctccctgag aaggtagagt
3241  atgtcatcaa atgcgacatg tcagccctgc agcgtgtgct gtaccgtcac atgcaggcca
3301  aaggtgtgct gctgactgac ggctccgaga aggacaagaa gggcaaaggt ggcaccaaga
3361  cactgatgaa cactattatg caactgcgta aagatctgca accaccctac atgttccagc
3421  acatcgagga gtccttttct gagcacttgg ggttcaccgg cggcatcgtg caaggattgg
```

TABLE 1-continued

```
3481  acctttaccg tgcctcaggg aaatttgaac ttcttgatag aattctaccc aaactccgtg
3541  caacgaacca taaagtgctc ctcttttgcc aaatgacctc cctcatgacc atcatggaag
3601  actactttgc ataccgtggc ttcaaatacc tcaggcttga tggaaccaca aaagcagaag
3661  accggggcat gctgttgaaa acctttaatg aacctggctc tgagtatttc attttcctgc
3721  tcagtacccg tgctgggggg ctgggcctga atctgcagtc agctgacact gtgatcatct
3781  ttgacagtga ctggaatccc caccaggacc tgcaagcaca ggatcgagcc catcgcattg
3841  gacagcagaa tgaggtgcgt gttcttcgcc tgtgcacggt caacagtgtg aagagaaga
3901  tactggctgc tgccaaatac aaactcaatg tggatcagaa ggtgatccag gcaggcatgt
3961  tcgaccagaa gtcgtccagc catgagaggc gtgccttcct gcaggccatc ctggagcacg
4021  aggagcagga tgaggaggaa gatgaggtgc ctgatgatga gaccgtcaac cagatgattg
4081  cccggcacga agaagagttt gacctcttca tgcgcatgga cttggaccgc cggcgtgaag
4141  aagcccgcaa ccccaagcgg aagccacgcc tgatggaaga ggatgagctc ccatcctgga
4201  tcatcaagga tgatgccgag gtggagcggc tgacatgtga agaggaagag gagaagatgt
4261  tcggccgtgg ttctcgccac cgcaaggagg tagactacag cgactcactg acagagaagc
4321  agtggctcaa ggctatcgag gagggcacgc tggaggagat cgaagaggag gtccggcaga
4381  agaaatcttc acgtaagcgt aagcgagaca gcgaggccgg ctcctccacc ccgaccacca
4441  gcacccgcag ccgtgacaag gatgaggaga gcaagaagca gaagaaacgt gggcggccac
4501  ctgctgagaa gctgtcccca aacccaccta acctcaccaa gaagatgaag aagatcgtgg
4561  atgctgtgat caagtacaaa gacagcagtg gacgtcagct cagcgaggtg ttcatccagc
4621  tcccctctcg caaggagctt cctgagtact atgagctcat ccgaaagcct gtggacttca
4681  agaagatcaa ggaacgcatc cgaaaccaca agtaccgcag cctcaatgac ctggagaagg
4741  atgtgatgct gctgtgccag aacgctcaga cgttcaacct cgagggttcc ctgatctatg
4801  aggactccat cgtcctgcag tctgtcttca ccagcgtacg gcagaagatt gagaaggagg
4861  acgacagtga aggcgaggaa agcgaggagg aggaggaggg cgaggaggaa ggctccgagt
4921  ctgagtcccg ctccgtcaag gtgaagatca agctgggccg caaggagaag gcccaggacc
4981  gactcaaggg gggccgccgg cggccaagcc ggggatcccg ggccaagccg gttgtgagtg
5041  acgatgacag tgaggaggag caggaggagg accgctcagg aagtggcagt gaggaagact
5101  gaaccagaca ttcctgagtc ctgaccccga ggcgctcgtc ccagccaaga tggagtagcc
5161  cttagcagtg atgggtagca ccagatgtag tttcgaactt ggagaactgt acacatgcaa
5221  tcttccacat ttttaggcag agaagtatag gcctgtctgt cggccctggc ctggcctcga
5281  gtctctacca gcattaactg tctagagagg ggacctcctg ggagcaccat ccacctcccc
5341  aggccccagt cactgtagct cagtggatgc atgcgcgtgc cggccgctcc ttgtactgta
5401  tcttactgga cagggccagc tctccaggag gctcacaggc ccagcgggta tgtcagtgtc
5461  actggagtca gacagtaata aattaaagca atgacaagcc accactggct ccctggactc
5521  cttgctgtca gcagtggctc cggggccaca gagaagaaag aaagactttt aggaactggg
5581  tctaacttat gggcaaagta cttgccttgc caggtgtatg ggttttgcat tcccatcacc
5641  cacacaccct aaacaagcca agtcagtgag cttcaagtta gagcctccac ctcaatgtgt
5701  acgtggaaag caatcaaaga tgatgcctag catccacctc tggccctcat gtgcagatgt
5761  acacacactg aattacatac acgggacaca cacatccaca cggaggcagt ccatgacttg
5821  cactggggag atggtaccat aggcgaaagt gccacaggca cagggccagg ctaatttagt
```

TABLE 1-continued

```
5881 cctgcagtcc tgtgctctta agatgaaggc acaaagagga accccaggcg ctccaactag
5941 catgccaggc agtgacaaga ccctgcttca aatgaatcag agcccacatt cagtattgcc
6001 ctcttacccg atgcgatgcc catgccctca catatgaatg tgtatatata catacatacg
6061 taaaataatt cttttttaaa ttatagacat ttttgtgtga atgttttgcc tgaatgtgtg
6121 tgtgtgtgtg tgtgtgtgtg tgtgtgtgtg tgtgtgtgta tcaagtacat tcctagagcc
6181 tacagaggtc aagggagggc attggatctg gaactggagt cacatgaggc tgtgagcaac
6241 tgtgtgggtt cctgggcctt tgcaacagca gttagtactc ttcaccactg agccatttct
6301 ccaatctcaa aaagaagcat tcttttaaat gaagactgaa ataaataagt aggacttgcc
6361 ttgg
```

SEQ ID NO: 71 Mouse BRG1 Amino Acid Sequence Isoform C (NP_001167550.1)

```
   1 mstpdpplgg tprpgpspgp gpspgamlgp spgpspgsah smmgpspgpp saghpmptqg
  61 pggypqdnmh qmhkpmesmh ekgmpddpry nqmkgmgmrs gahtgmappp spmdqhsqgy
 121 psplggseha sspvpasgps sgpqmssgpg gapldgsdpq algqqnrgpt pfnqnqlhql
 181 ragimaykml argqplpdhl qmavqgkrpm pgmqqqmptl pppsysatgp gpgpgpgpgp
 241 gpgpappnys rphgmggpnm pppgpsgvpp gmpgqppgqp pkpwpegpma naaaptstpq
 301 klippqptgr pspappavpp aaspvmppqt gspggpagpa plvplhqkqs ritpiqkprg
 361 ldpveilger eyrlgariah rigelenlpg slagdlrtka tielkalrll nfqrqlrgev
 421 vvcmrrdtal etalnakayk rskrqslrea riteklekqg kiegerkrrq khqeylnsil
 481 qhakdfreyh rsvtgklqkl tkavatyhan tereqkkene riekermrrl maedeegyrk
 541 lidqkkdkrl ayllqqtdey vanitelvrq hkaaqvakek kkkkkkkae naegqtpaig
 601 pdgepldets qmsdlpvkvi hvesgkiltg tdapkagqle awlemnpgye vaprsdsees
 661 gseeeeeeee eeqpqpaqpp tlpveekkki pdpdsddvse vdarhiiena kqdvddeygv
 721 sgalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvinth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf iflllstragg lglnlqsadt viifdsdwnp hqdlqaqdra hrigqgnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdseagsst pttstrsrdk deeskkqkkr grppaeklsp nppnitkkmk kivdavikyk
1441 dssgrqlsev fiqlpsrkel peyyelirkp vdfkkikeri rnhkyrslnd lekdvmllcq
1501 naqtfnlegs liyedsivlq svftsvrqki ekeddsegee seeeegeee gsesesrsvk
1561 vkiklgrkek aqdrlkggrr rpsrgsrakp vvsdddseee qeedrsgsgs eed
```

SEQ ID NO: 72 Human BRM cDNA Sequence Variant 1 (NM_003070.4, CDS: from 223 to 4995)

```
   1 gcgtcttccg cgcccgcgg aggaggcgag ggtgggacgc tgggcggagc ccgagtttag
  61 gaagaggagg ggacggctgt catcaatgaa gtcatattca taatctagtc ctctctccct
 121 ctgtttctgt actctgggtg actcagagag ggaagagatt cagccagcac actcctcgcg
```

TABLE 1-continued

```
 181   agcaagcatt actctactga ctggcagaga caggagaggt agatgtccac gcccacagac
 241   cctggtgcga tgccccaccc agggccttcg ccggggcctg ggccttcccc tgggccaatt
 301   cttgggccta gtccaggacc aggaccatcc ccaggttccg tccacagcat gatggggcca
 361   agtcctggac ctccaagtgt ctcccatcct atgccgacga tggggtccac agacttccca
 421   caggaaggca tgcatcaaat gcataagccc atcgatggta tacatgacaa ggggattgta
 481   gaagacatcc attgtggatc catgaagggc actggtatgc gaccacctca cccaggcatg
 541   ggccctcccc agagtccaat ggatcaacac agccaaggtt atatgtcacc acacccatct
 601   ccattaggag ccccagagca cgtctccagc cctatgtctg gaggaggccc aactccacct
 661   cagatgccac caagccagcc gggggccctc atcccaggtg atccgcaggc catgagccag
 721   cccaacagag gtccctcacc tttcagtcct gtccagctgc atcagcttcg agctcagatt
 781   ttagcttata aaatgctggc ccgaggccag cccctccccg aaacgctgca gcttgcagtc
 841   caggggaaaa ggacgttgcc tggcttgcag caacaacagc agcagcaaca gcagcagcag
 901   cagcagcagc agcagcagca gcagcagcaa cagcagccgc agcagcagcc gccgcaacca
 961   cagacgcagc aacaacagca gccggccctt gttaactaca acagaccatc tggcccgggg
1021   ccggagctga gcggcccgag caccccgcag aagctgccgg tgcccgcgcc cggcggccgg
1081   ccctcgcccg cgccccccgc agccgcgcag ccgcccgcgg ccgcagtgcc cgggccctca
1141   gtgccgcagc cggccccggg gcagccctcg cccgtcctcc agctgcagca gaagcagagc
1201   cgcatcagcc ccatccgaaa accgcaaggc ctggaccccg tggaaattct gcaagagcgg
1261   gaatacagac ttcaggcccg catagctcat aggatacaag aactggaaaa tctgcctggc
1321   tctttgccac cagatttaag aaccaaagca accgtggaac taaaagcact tcggttactc
1381   aatttccagc gtcagctgag acaggaggtg gtggcctgca tgcgcaggga cacgaccctg
1441   gagacggctc tcaactccaa agcatacaaa cggagcaagc gccagactct gagagaagct
1501   cgcatgaccg agaagctgga gaagcagcag aagattgagc aggagaggaa acgccgtcag
1561   aaacaccagg aatacctgaa cagtattttg caacatgcaa aagattttaa ggaatatcat
1621   cggtctgtgg ccggaaagat ccagaagctc tccaaagcag tggcaacttg catgccaac
1681   actgaaagag agcagaagaa ggagacagag cggattgaaa aggagagaat gcggcgactg
1741   atggctgaag atgaggaggg ttatagaaaa ctgattgatc aaaagaaaga caggcgttta
1801   gcttaccttt tgcagcagac cgatgagtat gtagccaatc tgaccaatct ggtttgggag
1861   cacaagcaag cccaggcagc caaagagaag aagaagagga ggaggaggaa gaagaaggct
1921   gaggagaatg cagagggtgg ggagtctgcc ctgggaccgg atggagagcc catagatgag
1981   agcagccaga tgagtgacct ccctgtcaaa gtgactcaca cagaaaccgg caaggttctg
2041   ttcggaccag aagcacccaa agcaagtcag ctggacgcct ggctggaaat gaatcctggt
2101   tatgaagttg cccctagatc tgacagtgaa gagagtgatt ctgattatga ggaagaggat
2161   gaggaagaag agtccagtag gcaggaaacc gaagagaaaa tactcctgga tccaaatagc
2221   gaagaagttt ctgagaagga tgctaagcag atcattgaga cagctaagca agacgtggat
2281   gatgaataca gcatgcagta cagtgccagg gctcccagt cctactacac cgtggctcat
2341   gccatctcgg agagggtgga gaaacagtct gccctcctaa ttaatgggac cctaaagcat
2401   taccagctcc agggcctgga atggatggtt tccctgtata ataacaactt gaacggaatc
2461   ttagccgatg aaatgggggct tggaaagacc atacagacca ttgcactcat cacttatctg
2521   atggagcaca aaagactcaa tggcccctat ctcatcattg ttccccttc gactctatct
```

TABLE 1-continued

```
2581  aactggacat atgaatttga caaatgggct ccttctgtgg tgaagatttc ttacaagggt
2641  actcctgcca tgcgtcgctc ccttgtcccc cagctacgga gtggcaaatt caatgtcctc
2701  ttgactactt atgagtatat tataaaagac aagcacattc ttgcaaagat tcggtggaaa
2761  tacatgatag tggacgaagg ccaccgaatg aagaatcacc actgcaagct gactcaggtc
2821  ttgaacactc actatgtggc ccccagaagg atcctcttga ctgggacccc gctgcagaat
2881  aagctccctg aactctgggc cctcctcaac ttcctcctcc caacaatttt taagagctgc
2941  agcacatttg aacaatggtt caatgctcca tttgccatga ctggtgaaag ggtggactta
3001  aatgaagaag aaactatatt gatcatcagg cgtctacata aggtgttaag accatttta
3061  ctaaggagac tgaagaaaga agttgaatcc cagcttcccg aaaaagtgga atatgtgatc
3121  aagtgtgaca tgtcagctct gcagaagatt ctgtatcgcc atatgcaagc caaggggatc
3181  cttctcacag atggttctga gaaagataag aaggggaaag gaggtgctaa gacacttatg
3241  aacactatta tgcagttgag aaaaatctgc aacccaccat atatgtttca gcacattgag
3301  gaatcctttg ctgaacacct aggctattca aatggggtca tcaatggggc tgaactgtat
3361  cgggcctcag ggaagtttga gctgcttgat cgtattctgc caaaattgag agcgactaat
3421  caccgagtgc tgcttttctg ccagatgaca tctctcatga ccatcatgga ggattatttt
3481  gcttttcgga acttcctta cctacgcctt gatggcacca ccaagtctga agatcgtgct
3541  gctttgctga agaaattcaa tgaacctgga tcccagtatt tcattttctt gctgagcaca
3601  agagctggtg gcctgggctt aaatcttcag gcagctgata cagtggtcat ctttgacagc
3661  gactggaatc ctcatcagga tctgcaggcc aagaccgag ctcaccgcat cgggcagcag
3721  aacgaggtcc gggtactgag gctctgtacc gtgaacagcg tggaggaaaa gatcctcgcg
3781  gccgcaaaat acaagctgaa cgtggatcag aaagtgatcc aggcgggcat gtttgaccaa
3841  aagtcttcaa gccacgagcg gagggcattc ctgcaggcca tcttggagca tgaggaggaa
3901  aatgaggaag aagatgaagt accggacgat gagactctga accaaatgat tgctcgacga
3961  gaagaagaat ttgacctttt tatgcggatg gacatggacc ggcggaggga agatgcccgg
4021  aacccgaaac ggaagccccg tttaatggag gaggatgagc tgcctcctg gatcattaag
4081  gatgacgctg aagtagaaag gctcacctgt gaagaagagg aggagaaaat atttgggagg
4141  gggtcccgcc agcgccgtga cgtggactac agtgacgccc tcacggagaa gcagtggcta
4201  agggccatcg aagacggcaa tttggaggaa atggaagagg aagtacggct taagaagcga
4261  aaaagacgaa gaaatgtgga taaagatcct gcaaaagaag atgtggaaaa agctaagaag
4321  agaagaggcc gccctcccgc tgagaaactg tcaccaaatc cccccaaact gacaaagcag
4381  atgaacgcta tcatcgatac tgtgataaac tacaaagata ggtgtaacgt ggagaaggtg
4441  cccagtaatt ctcagttgga aatagaagga aacagttcag gcgacagct cagtgaagtc
4501  ttcattcagt taccttcaag gaaagaatta ccagaatact atgaattaat taggaagcca
4561  gtggatttca aaaaataaa ggaaggatt cgtaatcata agtaccggag cctaggcgac
4621  ctggagaagg atgtcatgct tctctgtcac aacgctcaga cgttcaacct ggagggatcc
4681  cagatctatg aagactccat cgtcttacag tcagtgttta agagtgcccg gcagaaaatt
4741  gccaaagagg aagagagtga ggatgaaagc aatgaagagg aggaagagga agatgaagaa
4801  gagtcagagt ccgaggcaaa atcagtcaag gtgaaaatta agctcaataa aaaagatgac
4861  aaaggccggg acaaagggaa aggcaagaaa aggccaaatc gaggaaaagc caaacctgta
4921  gtgagcgatt ttgacagcga tgaggagcag gatgaacgtg aacagtcaga aggaagtggg
```

TABLE 1-continued

```
4981  acggatgatg agtgatcagt atggaccttt ttccttggta gaactgaatt ccttcctccc 5041  ctgtctcatt tctacccagt gagttcattt gtcataiagg cactgggttg tttctatatc 5101  atcatcgtct ataaactagc tttaggatag tgccagacaa acatatgata tcatggtgta 5161  aaaaacacac acatacacaa atatttgtaa catattgtga ccaaatgggc ctcaaagatt 5221  cagattgaaa caaacaaaaa gcttttgatg gaaaatatgt gggtggatag tatatttcta 5281  tgggtgggtc taatttggta acggtttgat tgtgcctggt tttatcacct gttcagatga 5341  gaagattttt gtcttttgta gcactgataa ccaggagaag ccattaaaag ccactggtta 5401  ttttattttt catcaggcaa ttttcgaggt tttatttgt tcggtattgt tttttacac 5461  tgtggtacat ataagcaact ttaataggtg ataaatgtac agtagttaga tttcacctgc 5521  atatacattt ttccatttta tgctctatga tctgaacaaa gcttttgga attgtataag 5581  atttatgtct actgtaaaca ttgcttaatt tttttgctct tgatttaaaa aaaagttttg 5641  ttgaaagcgc tattgaatat tgcaatctat atagtgtatt ggatggcttc ttttgtcacc 5701  ctgatctcct atgttaccaa tgtgtatcgt ctccttctcc ctaaagtgta cttaatcttt 5761  gctttctttg cacaatgtct ttggttgcaa gtcataagcc tgaggcaaat aaaattccag 5821  taatttcgaa gaatgtggtg ttggtgcttt cctaataaag aaataattta gcttgacaaa 5881  aaaaaaaaaa aa
```

SEQ ID NO: 73 Human BRM Amino Acid Sequence Isoform A (NP_003061.3)
```
   1  mstptdpgam phpgpspgpg pspgpilgps pgpgpspgsv hsmmgpspgp psyshpmptm 61  gstdfpgegm hqmhkpidgi hdkgivedih cgsmkgtgmr pphpgmgppq spmdqhsqgy 121  msphpsplga pehvsspmsg ggptppqmpp sqpgalipgd pqamsqpnrg pspfspvglh 181  qlragilayk mlargqplpe tlglavqgkr tlpglqqqqq qqqqqqqqq qqqqqqqpq 241  qqppqpqtqq qqqpalvnyn rpsgpgpels gpstpqklpv papggrpspa ppaaaqppaa 301  avpgpsvpqp apgqpspvlq lqqkqsrisp iqkpqgldpv eilgereyrl gariahrige 361  lenlpgslpp dlrtkatvel kalrllnfqr qlrgevvacm rrdttletal nskaykrskr 421  qtlrearmte klekqqkieq erkrrqkhqe ylnsilqhak dfkeyhrsva gkiqklskav 481  atwhantere qkketeriek ermrrlmaed eegyrklidq kkdrrlayll qqtdeyvanl 541  tnlvwehkqa qaakekkkrr rrkkkaeena eggesalgpd gepidessqm sdlpvkvtht 601  etgkvlfgpe apkasqldaw lemnpgyeva prsdseesds dyeeedeeee ssrqeteeki 661  lldpnseevs ekdakqiiet akqdvddeys mgysargsgs yytvahaise rvekqsalli 721  ngtlkhyqlq glewmvslyn nnlngilade mglgktiqti alitylmehk ringpyliiv 781  plstlsnwty efdkwapsvv kisykgtpam rrslvpqlrs gkfnvlltty eyiikdkhil 841  akirwkymiv deghrmknhh ckltqvinth yvaprrillt gtplqnklpe lwallnfllp 901  tifkscstfe qwfnapfamt gervdlneee tiliirrlhk vlrpfllrrl kkevesqlpe 961  kveyvikcdm salqkilyrh mqakgilltd gsekdkkgkg gaktlmntim qlrkicnhpy 1021  mfqhieesfa ehlgysngvi ngaelyrasg kfelldrilp klratnhrvl lfcgmtslmt 1081  imedyfafrn flylrldgtt ksedraallk kfnepgsqyf iflllstragg lglnlqaadt 1141  vvifdsdwnp hqdlqaqdra hrigqgnevr vlrlctvnsv eekilaaaky klnvdqkviq 1201  agmfdqksss herraflqai leheeeneee devpddetln qmiarreeef dlfmrmdmdr 1261  rredarnpkr kprlmeedel pswiikddae verltceeee ekifgrsrq rrdvdysdal 1321  tekqwlraie dgnleemeee vrlkkrkrrr nvdkdpaked vekakkrrgr ppaeklspnp 1381  pkltkqmnai idtvinykdr cnvekvpsns qleiegnssg rqlsevfiql psrkelpeyy
```

TABLE 1-continued

```
1441 elirkpvdfk kikerirnhk yrslgdlekd vmllchnaqt fnlegsqiye dsivlqsvfk 1501 sarqkiakee esedesneee eeedeeeses eaksvkvkik lnkkddkgrd kgkgkkrpnr 1561 gkakpvvsdf dsdeecidere qsegsgtdde
```

SEQ ID NO: 74 Human BRM cDNA Sequence Variant 2 (NM_139045.3, CDS: from 223 to 4941)

```
   1 gcgtcttccg gcgcccgcgg aggaggcgag ggtgggacgc tgggcggagc ccgagtttag 61 gaagaggagg ggacggctgt catcaatgaa gtcatattca taatctagtc ctctctccct 121 ctgtttctgt actctgggtg actcagagag ggaagagatt cagccagcac actcctcgcg 181 agcaagcatt actctactga ctggcagaga caggagaggt agatgtccac gcccacagac 241 cctggtgcga tgccccaccc agggccttcg ccggggcctg gccttcccc tgggccaatt 301 cttgggccta gtccaggacc aggaccatcc ccaggttccg tccacagcat gatggggcca 361 agtcctggac ctccaagtgt ctcccatcct atgccgacga tggggtccac agacttccca 421 caggaaggca tgcatcaaat gcataagccc atcgatggta tacatgacaa ggggattgta 481 gaagacatcc attgtggatc catgaagggc actggtatgc gaccacctca cccaggcatg 541 ggccctcccc agagtccaat ggatcaacac agccaaggtt atatgtcacc acacccatct 601 ccattaggag ccccagagca cgtctccagc cctatgtctg gaggaggccc aactccacct 661 cagatgccac caagccagcc gggggccctc atcccaggtg atccgcaggc catgagccag 721 cccaacagag gtccctcacc tttcagtcct gtccagctgc atcagcttcg agctcagatt 781 ttagcttata aaatgctggc ccgaggccag cccctccccg aaacgctgca gcttgcagtc 841 caggggaaaa ggacgttgcc tggcttgcag caacaacagc agcagcaaca gcagcagcag 901 cagcagcagc agcagcagca gcagcagcaa cagcagccgc agcagcagcc gccgcaacca 961 cagacgcagc aacaacagca gccggcccct gttaactaca acagaccatc tggcccgggg 1021 ccggagctga gcggcccgag caccccgcag aagctgccgg tgcccgcgcc cggcggccgg 1081 ccctcgcccg cgccccccgc agccgcgcag ccgcccgcgg ccgcagtgcc cgggccctca 1141 gtgccgcagc cggccccggg gcagccctcg cccgtcctcc agctgcagca gaagcagagc 1201 cgcatcagcc ccatccagaa accgcaaggc ctggacccccg tggaaattct gcaagagcgg 1261 gaatacagac ttcaggcccg catagctcat aggatacaag aactggaaaa tctgcctggc 1321 tctttgccac cagatttaag aaccaaagca accgtggaac taaaagcact tcggttactc 1381 aatttccagc gtcagctgag acaggaggtg gtggcctgca tgcgcaggga cacgaccctg 1441 gagacggctc tcaactccaa agcatacaaa cggagcaagc gccagactct gagagaagct 1501 cgcatgaccg agaagctgga gaagcagcag aagattgagc aggagaggaa acgccgtcag 1561 aaacaccagg aatacctgaa cagtattttg caacatgcaa agatttttaa ggaatatcat 1621 cggtctgtgg ccggaaagat ccagaagctc tccaaagcag tggcaacttg gcatgccaac 1681 actgaaagag agcagaagaa ggagacagag cggattgaaa aggagagaat gcggcgactg 1741 atggctgaag atgaggaggg ttatagaaaa ctgattgatc aaaagaaaga caggcgttta 1801 gcttaccttt tgcagcagac cgatgagtat gtagccaatc tgaccaatct ggtttgggag 1861 cacaagcaag cccaggcagc caaagaaag aagaagagga ggaggaggaa gaagaaggct 1921 gaggagaatg cagagggtgg ggagtctgcc ctgggaccgg atggagagcc catagatgag 1981 agcagccaga tgagtgacct ccctgtcaaa gtgactcaca cagaaaccgg caaggttctg 2041 ttcggaccag aagcacccaa agcaagtcag ctggacgcct ggctggaaat gaatcctggt 2101 tatgaagttg cccctagatc tgacagtgaa gagagtgatt ctgattatga ggaagaggat
```

TABLE 1-continued

```
2161  gaggaagaag agtccagtag gcaggaaacc gaagagaaaa tactcctgga tccaaatagc
2221  gaagaagttt ctgagaagga tgctaagcag atcattgaga cagctaagca agacgtggat
2281  gatgaataca gcatgcagta cagtgccagg ggctcccagt cctactacac cgtggctcat
2341  gccatctcgg agagggtgga gaaacagtct gccctcctaa ttaatgggac cctaaagcat
2401  taccagctcc agggcctgga atggatggtt tccctgtata ataacaactt gaacggaatc
2461  ttagccgatg aaatgggcct tggaaagacc atacagacca ttgcactcat cacttatctg
2521  atggagcaca aaagactcaa tggcccctat ctcatcattg ttccccttc gactctatct
2581  aactggacat atgaatttga caaatgggct ccttctgtgg tgaagatttc ttacaagggt
2641  actcctgcca tgcgtcgctc ccttgtcccc cagctacgga gtggcaaatt caatgtcctc
2701  ttgactactt atgagtatat tataaaagac aagcacattc ttgcaaagat tcggtggaaa
2761  tacatgatag tggacgaagg ccaccgaatg aagaatcacc actgcaagct gactcaggtc
2821  ttgaacactc actatgtggc ccccagaagg atcctcttga ctgggacccc gctgcagaat
2881  aagctccctg aactctgggc cctcctcaac ttcctcctcc caacaatttt taagagctgc
2941  agcacatttg aacaatggtt caatgctcca tttgccatga ctggtgaaag ggtggactta
3001  aatgaagaag aaactatatt gatcatcagg cgtctacata aggtgttaag accatttta
3061  ctaaggagac tgaagaaaga agttgaatcc cagcttcccg aaaaagtgga atatgtgatc
3121  aagtgtgaca tgtcagctct gcagaagatt ctgtatcgcc atatgcaagc caggggatc
3181  cttctcacag atggttctga aaagataag aaggggaaag gaggtgctaa gacacttatg
3241  aacactatta tgcagttgag aaaaatctgc aaccacccat atatgtttca gcacattgag
3301  gaatcctttg ctgaacacct aggctattca aatggggtca tcaatggggc tgaactgtat
3361  cgggcctcag ggaagtttga gctgcttgat cgtattctgc caaaattgag agcgactaat
3421  caccgagtgc tgcttttctg ccagatgaca tctctcatga ccatcatgga ggattatttt
3481  gcttttcgga acttcctta cctacgcctt gatggcacca ccaagtctga agatcgtgct
3541  gctttgctga agaaattcaa tgaacctgga tcccagtatt tcattttctt gctgagcaca
3601  agagctggtg gcctgggctt aaatcttcag gcagctgata cagtggtcat ctttgacagc
3661  gactggaatc ctcatcagga tctgcaggcc caagaccgag ctcaccgcat cgggcagcag
3721  aacgaggtcc gggtactgag gctctgtacc gtgaacagcg tggaggaaaa gatcctcgcg
3781  gccgcaaaat acaagctgaa cgtggatcag aaagtgatcc aggcgggcat gtttgaccaa
3841  aagtcttcaa gccacgagcg gagggcattc ctgcaggcca tcttggagca tgaggaggaa
3901  aatgaggaag aagatgaagt accggacgat gagactctga accaaatgat tgctcgacga
3961  gaagaagaat ttgacctttt tatgcgaatg gacatggacc ggcggaggga agatgcccgg
4021  aacccgaaac ggaagccccg tttaatggag gaggatgagc tgccctcctg gatcattaag
4081  gatgacgctg aagtagaaag gctcacctgt gaagaagagg aggagaaaat atttgggagg
4141  gggtcccgcc agcgccgtga cgtggactac agtgacgccc tcacggagaa gcagtggcta
4201  agggccatcg aagacggcaa tttggaggaa atggaagagg aagtacggct aagaagcga
4261  aaaagacgaa gaatgtggaa taaagatcct gcaaaagaag atgtggaaaa agctaagaag
4321  agaagaggcc gccctcccgc tgagaaactg tcaccaaatc cccccaaact gacaaagcag
4381  atgaacgcta tcatcgatac tgtgataaac tacaaagata gttcagggcg acagctcagt
4441  gaagtcttca ttcagttacc ttcaaggaaa gaattaccag aatactatga attaattagg
4501  aagccagtgg atttcaaaaa aataaaggaa aggattcgta atcataagta ccggagccta
```

TABLE 1-continued

```
4561  ggcgacctgg agaaggatgt catgcttctc tgtcacaacg ctcagacgtt caacctggag
4621  ggatcccaga tctatgaaga ctccatcgtc ttacagtcag tgtttaagag tgcccggcag
4681  aaaattgcca agaggaaga gagtgaggat gaaagcaatg aagaggagga agaggaagat
4741  gaagaagagt cagagtccga ggcaaaatca gtcaaggtga aaattaagct caataaaaaa
4801  gatgacaaag gccgggacaa agggaaaggc aagaaaaggc caaatcgagg aaaagccaaa
4861  cctgtagtga gcgattttga cagcgatgag gagcaggatg aacgtgaaca gtcagaagga
4921  agtgggacgg atgatgagtg atcagtatgg accttttttcc ttggtagaac tgaattcctt
4981  cctcccctgt ctcatttcta cccagtgagt tcatttgtca tataggcact gggttgtttc
5041  tatatcatca tcgtctataa actagcttta ggatagtgcc agacaaacat atgatatcat
5101  ggtgtaaaaa acacacacat acacaaatat ttgtaacata ttgtgaccaa atgggcctca
5161  aagattcaga ttgaaacaaa caaaaagctt ttgatggaaa atatgtgggt ggatagtata
5221  tttctatggg tgggtctaat ttggtaacgg tttgattgtg cctggtttta tcacctgttc
5281  agatgagaag attttttgtct tttgtagcac tgataaccag gagaagccat taaaagccac
5341  tggttatttt attttttcatc aggcaatttt cgaggttttt atttgttcgg tattgttttt
5401  ttacactgtg gtacatataa gcaactttaa taggtgataa atgtacagta gttagatttc
5461  acctgcatat acattttttcc attttatgct ctatgatctg aacaaaagct ttttgaattg
5521  tataagattt atgtctactg taaacattgc ttaattttttt tgctcttgat ttaaaaaaaa
5581  gttttgttga aagcgctatt gaatattgca atctatatag tgtattggat ggcttctttt
5641  gtcaccctga tctcctatgt taccaatgtg tatcgtctcc ttctccctaa agtgtactta
5701  atctttgctt tctttgcaca atgtctttgg ttgcaagtca taagcctgag gcaaataaaa
5761  ttccagtaat ttcgaagaat gtggtgttgg tgctttccta ataaagaaat aatttagctt
5821  gacaaaaaaa aaaaaaaa
```

SEQ ID NO: 75 Human BRM Amino Acid Sequence Isoform B (NP_620614.2)

```
   1  mstptdpgam phpgpspgpg pspgpilgps pgpgpspgsv hsmmgpspgp psyshpmptm
  61  gstdfpgegm hqmhkpidgi hdkgivedih cgsmkgtgmr pphpgmgppq spmdqhsqgy
 121  msphpsplga pehvsspmsg ggptppqmpp sqpgalipgd pqamsqpnrg pspfspvglh
 181  qlragilayk mlargqplpe tlglavqgkr tlpglqqqqq qqqqqqqqq qqqqqqqpq
 241  qqppqpqtqq qqqpalvnyn rpsgpgpels gpstpqklpv papggrpspa ppaaaqppaa
 301  avpgpsvpqp apgqpspvlq lqqkqsrisp iqkpqgldpv eilgereyrl gariahrige
 361  lenlpgslpp dlrtkatvel kalrllnfqr qlrgevvacm rrdttletal nskaykrskr
 421  qtlrearmte klekqqkieq erkrrqkhqe ylnsilqhak dfkeyhrsva gkiqklskav
 481  atwhantere qkketeriek ermrrlmaed eegyrklidq kkdrrlayll qqtdeyvanl
 541  tnlvwehkqa qaakekkkrr rrkkkaeena eggesalgpd gepidessqm sdlpvkvtht
 601  etgkvlfgpe apkasqldaw lemnpgyeva prsdseesds dyeeedeeee ssrqeteeki
 661  lldpnseevs ekdakqiiet akqdvddeys mgysargsgs yytvahaise rvekqsalli
 721  ngtlkhyqlq glewmvslyn nnlngilade mglgktiqti alitylmehk ringpyliiv
 781  plstlsnwty efdkwapsvv kisykgtpam rrslvpqlrs gkfnvlltty eyiikdkhil
 841  akirwkymiv deghrmknhh ckltqvinth yvaprrillt gtplqnklpe lwallnfllp
 901  tifkscstfe qwfnapfamt gervdlneee tiliirrlhk vlrpfllrrl kkevesqlpe
 961  kveyvikcdm salqkilyrh mqakgilltd gsekdkkgkg gaktlmntim qlrkicnhpy
1021  mfqhieesfa ehlgysngvi ngaelyrasg kfelldrilp klratnhrvl lfcgmtslmt
```

TABLE 1-continued

```
1081  imedyfafrn flylrldgtt ksedraallk kfnepgsqyf ifllstragg lglnlqaadt 1141  vvifdsdwnp hqdlqaqdra hrigqgnevr vlrlctvnsv eekilaaaky klnvdqkviq 1201  agmfdqksss herraflqai leheeeneee devpddetln qmiarreeef dlfmrmdmdr 1261  rredarnpkr kprlmeedel pswiikddae verltceeee ekifgrgsrq rrdvdysdal 1321  tekqwlraie dgnleemeee vrlkkrkrrr nvdkdpaked vekakkrrgr ppaeklspnp 1381  pkltkqmnai idtvinykds sgrqlsevfi qlpsrkelpe yyelirkpvd fkkikerirn 1441  hkyrslgdle kdvmllchna qtfnlegsqi yedsivlqsv fksarqkiak eeesedesne 1501  eeeeedeees eseaksvkvk iklnkkddkg rdkgkgkkrp nrgkakpvvs dfdsdeeqde 1561  reqsegsgtd de
```

SEQ ID NO: 76 Human BRM cDNA Sequence Variant 3 (NM_001289396.1, CDS: from 210 to 4982)

```
   1  tcagaagaaa gccccgagat cacagagacc cggcgagatc acagagaccc ggcctgaagg 61  aacgtggaaa gaccaatgta cctgttttga ccggttgcct ggagcaagaa gttccagttg 121  gggagaattt tcagaagata aagtcggaga ttgtggaaag acttgacttg cagcattact 181  ctactgactg gcagagacag gagaggtaga tgtccacgcc cacagacccc tggtgcgatgc 241  cccacccagg gccttcgccg gggcctgggc cttcccctgg ccaattctt gggcctagtc 301  caggaccagg accatcccca ggttccgtcc acagcatgat ggggccaagt cctggacctc 361  caagtgtctc ccatcctatg ccgacgatgg ggtccacaga cttcccacag gaaggcatgc 421  atcaaatgca taagcccatc gatggtatac atgacaaggg gattgtagaa gacatccatt 481  gtggatccat gaagggcact ggtatgcgac cacctcaccc aggcatgggc cctcccccaga 541  gtccaatgga tcaacacagc caaggttata tgtcaccaca cccatctcca ttaggagccc 601  cagagcacgt ctccagccct atgtctggag gaggcccaac tccacctcag atgccaccaa 661  gccagccggg ggccctcatc ccaggtgatc cgcaggccat gagccagccc aacagaggtc 721  cctcaccttt cagtcctgtc cagctgcatc agcttcgagc tcagatttta gcttataaaa 781  tgctggcccg aggccagccc ctccccgaaa cgctgcagct tgcagtccag gggaaaagga 841  cgttgcctgg cttgcagcaa caacagcagc agcaacagca gcagcagcag cagcagcagc 901  agcagcagca gcagcaacag cagccgcagc agcagccgcc gcaaccacag acgcagcaac 961  aacagcagcc ggcccttgtt aactacaaca gaccatctgg cccgggggccg gagctgagcg 1021  gcccgagcac cccgcagaag ctgccggtgc ccgcgcccgg cggccggccc tcgcccgcgc 1081  ccccccgcagc cgcgcagccg cccgcggccg cagtgcccgg gccctcagtc ccgcagccgg 1141  ccccggggca gccctcgccc gtcctccagc tgcagcagaa gcagagccgc atcagcccca 1201  tccagaaacc gcaaggcctg gaccccgtgg aaattctgca agagcgggaa tacagacttc 1261  aggcccgcat agctcatagg atacaagaac tggaaaatct gcctggctct ttgccaccag 1321  atttaagaac caaagcaacc gtggaactaa aagcacttcg gttactcaat ttccagcgtc 1381  agctgagaca ggaggtggtg gcctgcatgc gcaggacac gaccctggag acggctctca 1441  actccaaagc atacaaacgg agcaagcgcc agactctgag agaagctcgc atgaccgaga 1501  agctggagaa gcagcagaag attgagcagg agaggaaacg ccgtcagaaa caccaggaat 1561  acctgaacag tatttttgcaa catgcaaaag attttaagga atatcatcgg tctgtggccg 1621  gaaagatcca gaagctctcc aaagcagtgg caactggca tgccaacact gaaagagagc 1681  agaagaagga gacagagcgg attgaaaagg agagaatgcg gcgactgatg gctgaagatg 1741  aggagggtta tagaaaactg attgatcaaa agaaagacag gcgtttagct taccttttgc
```

TABLE 1-continued

```
1801  agcagaccga tgagtatgta gccaatctga ccaatctggt ttgggagcac aagcaagccc 1861  aggcagccaa agagaagaag aagaggagga ggaggaagaa gaaggctgag gagaatgcag 1921  agggtgggga gtctgccctg ggaccggatg gagagcccat agatgagagc agccagatga 1981  gtgacctccc tgtcaaagtg actcacacag aaaccggcaa ggttctgttc ggaccagaag 2041  cacccaaagc aagtcagctg gacgcctggc tggaaatgaa tcctggttat gaagttgccc 2101  ctagatctga cagtgaagag agtgattctg attatgagga agaggatgag aagaagagt 2161  ccagtaggca ggaaaccgaa gagaaaatac tcctggatcc aaatagcgaa gaagtttctg 2221  agaaggatgc taagcagatc attgagacag ctaagcaaga cgtggatgat gaatacagca 2281  tgcagtacag tgccaggggc tcccagtcct actacaccgt ggctcatgcc atctcggaga 2341  gggtggagaa acagtctgcc ctcctaatta atgggaccct aaagcattac cagctccagg 2401  gcctggaatg gatggtttcc ctgtataata caacttgaa cggaatctta gccgatgaaa 2461  tggggcttgg aaagaccata cagaccattg cactcatcac ttatctgatg gagcacaaaa 2521  gactcaatgg cccctatctc atcattgttc ccctttcgac tctatctaac tggacatatg 2581  aatttgacaa atgggctcct tctgtggtga agatttctta caagggtact cctgccatgc 2641  gtcgctccct tgtcccccag ctacggagtg gcaaattcaa tgtcctcttg actacttatg 2701  agtatattat aaaagacaag cacattcttg caaagattcg gtggaaatac atgatagtgg 2761  acgaaggcca ccgaatgaag aatcaccact gcaagctgac tcaggtcttg aacactcact 2821  atgtggcccc cagaaggatc ctcttgactg gaccccgct gcagaataag ctccctgaac 2881  tctgggccct cctcaacttc ctcctcccaa caattttaa gagctgcagc acatttgaac 2941  aatggttcaa tgctccattt gccatgactg tgaaagggt ggacttaaat gaagaagaaa 3001  ctatattgat catcaggcgt ctacataagg tgttaagacc attttacta aggagactga 3061  agaaagaagt tgaatcccag cttcccgaaa aagtggaata tgtgatcaag tgtgacatgt 3121  cagctctgca gaagattctg tatcgccata tgcaagccaa ggggatcctt ctcacagatg 3181  gttctgagaa agataagaag gggaaaggag gtgctaagac acttatgaac actattatgc 3241  agttgagaaa aatctgcaac cacccatata tgtttcagca cattgaggaa tcctttgctg 3301  aacacctagg ctattcaaat ggggtcatca atggggctga actgtatcgg gcctcaggga 3361  agtttgagct gcttgatcgt attctgccaa aattgagagc gactaatcac cgagtgctgc 3421  ttttctgcca gatgacatct ctcatgacca tcatggagga ttattttgct tttcggaact 3481  tcctttacct acgccttgat ggcaccacca gtctgaaga tcgtgctgct ttgctgaaga 3541  aattcaatga acctggatcc cagtatttca ttttcttgct gagcacaaga gctggtggcc 3601  tgggcttaaa tcttcaggca gctgatacag tggtcatctt tgacagcgac tggaatcctc 3661  atcaggatct gcaggcccaa gaccgagctc accgcatcgg gcagcagaac gaggtccggg 3721  tactgaggct ctgtaccgtg aacagcgtgg aggaaaagat cctcgcggcc gcaaaataca 3781  agctgaacgt ggatcagaaa gtgatccagg cgggcatgtt tgaccaaaag tcttcaagcc 3841  acgagcggag ggcattcctg caggccatct ggagcatga ggaggaaaat gaggaagaag 3901  atgaagtacc ggacgatgag actctgaacc aaatgattgc tcgacgagaa gaagaatttg 3961  accttttat gcggatggac atggaccggc ggagggaaga tgcccggaac ccgaaacgga 4021  agccccgttt aatggaggag gatgagctgc cctcctggat cattaaggat gacgctgaag 4081  tagaaaggct cacctgtgaa gaagaggagg agaaaatatt tgggaggggg tcccgccagc 4141  gccgtgacgt ggactacagt gacgccctca cggagaagca gtggctaagg gccatcgaag
```

TABLE 1-continued

```
4201  acggcaattt ggaggaaatg gaagaggaag tacggcttaa gaagcgaaaa agacgaagaa
4261  atgtggataa agatcctgca aaagaagatg tggaaaaagc taagaagaga agaggccgcc
4321  ctcccgctga gaaactgtca ccaaatcccc ccaaactgac aaagcagatg aacgctatca
4381  tcgatactgt gataaactac aaagataggt gtaacgtgga gaaggtgccc agtaattctc
4441  agttggaaat agaaggaaac agttcagggc gacagctcag tgaagtcttc attcagttac
4501  cttcaaggaa agaattacca gaatactatg aattaattag gaagccagtg gatttcaaaa
4561  aaataaagga aaggattcgt aatcataagt accggagcct aggcgacctg gagaaggatg
4621  tcatgcttct ctgtcacaac gctcagacgt caacctgga gggatcccag atctatgaag
4681  actccatcgt cttacagtca gtgtttaaga gtgcccggca gaaaattgcc aaagaggaag
4741  agagtgagga tgaaagcaat gaagaggagg aagaggaaga tgaagaagag tcagagtccg
4801  aggcaaaatc agtcaaggtg aaaattaagc tcaataaaaa agatgacaaa ggccgggaca
4861  aagggaaagg caagaaaagg ccaaatcgag gaaaagccaa acctgtagtg agcgattttg
4921  acagcgatga ggagcaggat gaacgtgaac agtcagaagg aagtgggacg gatgatgagt
4981  gatcagtatg gacctttttc cttggtagaa ctgaattcct tcctcccctg tctcatttct
5041  acccagtgag ttcatttgtc atataggcac tgggttgttt ctatatcatc atcgtctata
5101  aactagcttt aggatagtgc cagacaaaca tatgatatca tggtgtaaaa aacacacaca
5161  tacacaaata tttgtaacat attgtgacca aatgggcctc aaagattcag attgaaacaa
5221  acaaaaagct tttgatggaa atatatgtggg tggatagtat atttctatgg gtgggtctaa
5281  tttggtaacg gtttgattgt gcctggtttt atcacctgtt cagatgagaa gattttgtc
5341  ttttgtagca ctgataacca ggagaagcca ttaaaagcca ctggttattt tatttttcat
5401  caggcaattt tcgaggtttt tatttgttcg gtattgtttt tttacactgt ggtacatata
5461  agcaactta ataggtgata aatgtacagt agttagattt cacctgcata tacattttc
5521  cattttatgc tctatgatct gaacaaaagc ttttttgaatt gtataagatt tatgtctact
5581  gtaaacattg cttaattttt ttgctcttga tttaaaaaaa agttttgttg aaagcgctat
5641  tgaatattgc aatctatata gtgtattgga tggcttcttt tgtcaccctg atctcctatg
5701  ttaccaatgt gtatcgtctc cttctcccta aagtgtactt aatctttgct ttctttgcac
5761  aatgtctttg gttgcaagtc ataagcctga ggcaaataaa attccagtaa tttcgaagaa
5821  tgtggtgttg gtgctttcct aataaagaaa taatttagct tgacaaaaaa aaaaaaaaa
```

SEQ ID NO: 77 Human BRM cDNA Sequence Variant 4 (NM_001289397.1, CDS: from 223 to 4767)

```
  1  gcgtcttccg gcgcccgcgg aggaggcgag ggtgggacgc tgggcggagc ccgagtttag
 61  gaagaggagg ggacggctgt catcaatgaa gtcatattca taatctagtc ctctctccct
121  ctgtttctgt actctgggtg actcagagag ggaagagatt cagccagcac actcctcgcg
181  agcaagcatt actctactga ctggcagaga caggagaggt agatgtccac gcccacagac
241  cctggtgcga tgccccaccc agggccttcg ccggggcctg ggccttccc tgggccaatt
301  cttgggccta gtccaggacc aggaccatcc ccaggttccg tccacagcat gatggggcca
361  agtcctggac ctccaagtgt ctcccatcct atgccgacga tggggtccac agacttccca
421  caggaaggca tgcatcaaat gcataagccc atcgatggta tacatgacaa ggggattgta
481  gaagacatcc attgtggatc catgaagggc actggtatgc gaccacctca cccaggcatg
541  ggccctcccc agagtccaat ggatcaacac agccaaggtt atatgtcacc acacccatct
601  ccattaggag ccccagagca cgtctccagc cctatgtctg gaggaggccc aactccacct
```

TABLE 1-continued

```
 661  cagatgccac caagccagcc gggggccctc atcccaggtg atccgcaggc catgagccag
 721  cccaacagag gtccctcacc tttcagtcct gtccagctgc atcagcttcg agctcagatt
 781  ttagcttata aaatgctggc ccgaggccag cccctccccg aaacgctgca gcttgcagtc
 841  caggggaaaa ggacgttgcc tggcttgcaa caacaacagc agcagcaaca gcagcagcag
 901  cagcagcagc agcagcagca gcagcagcaa cagcagccgc agcagcagcc gccgcaacca
 961  cagacgcagc aacaacagca gccggccctt gttaactaca acagaccatc tggcccgggg
1021  ccggagctga gcggcccgag caccccgcag aagctgccgg tgcccgcgcc cggcggccgg
1081  ccctcgcccg cgccccccgc agccgcgcag ccgcccgcgg ccgcagtgcc cgggccctca
1141  gtgccgcagc cggccccggg gcagccctcg cccgtcctcc agctgcagca gaagcagagc
1201  cgcatcagcc ccatccagaa accgcaaggc ctggacccccg tggaaattct gcaagagcgg
1261  gaatacagac ttcaggcccg catagctcat aggatacaag aactggaaaa tctgcctggc
1321  tcttttgccac cagatttaag aaccaaagca accgtggaac taaaagcact tcggttactc
1381  aatttccagc gtcagctgag acaggaggtg gtggcctgca tgcgcaggga cacgaccctg
1441  gagacggctc tcaactccaa agcatacaaa cggagcaagc gccagactct gagagaagct
1501  cgcatgaccg agaagctgga gaagcagcag aagattgagc aggagaggaa acgccgtcag
1561  aaacaccagg aatacctgaa cagtattttg caacatgcaa agattttaa ggaatatcat
1621  cggtctgtgg ccggaaagat ccagaagctc tccaaagcag tggcaacttg gcatgccaac
1681  actgaaagag agcagaagaa ggagacagag cggattgaaa aggagagaat gcggcgactg
1741  atggctgaag atgaggaggg ttatagaaaa ctgattgatc aaaagaaaga caggcgttta
1801  gcttaccttt tgcagcagac cgatgagtat gtagccaatc tgaccaatct ggtttgggag
1861  cacaagcaag cccaggcagc caaagagaag aagaagagga ggaggaggaa gaagaaggct
1921  gaggagaatg cagagggtgg ggagtctgcc ctgggaccgg atggagagcc catagatgag
1981  agcagccaga tgagtgacct ccctgtcaaa gtgactcaca cagaaaccgg caaggttctg
2041  ttcggaccag aagcacccaa agcaagtcag ctggacgcct ggctggaaat gaatcctggt
2101  tatgaagttg cccctagatc tgacagtgaa gagagtgatt ctgattatga ggaagaggat
2161  gaggaagaag agtccagtag gcaggaaacc gaagagaaaa tactcctgga tccaaatagc
2221  gaagaagttt ctgagaagga tgctaagcag atcattgaga cagctaagca agacgtggat
2281  gatgaataca gcatgcagta cagtgccagg ggctcccagt cctactacac cgtggctcat
2341  gccatctcgg agagggtgga gaaacagtct gccctcctaa ttaatgggac cctaaagcat
2401  taccagctcc agggcctgga atggatggtt tccctgtata ataacaactt gaacggaatc
2461  ttagccgatg aaatgggct tggaaagacc atacagacca ttgcactcat cacttatctg
2521  atggagcaca aaagactcaa tggcccctat ctcatcattg ttcccctttc gactctatct
2581  aactggacat atgaatttga caaatgggct ccttctgtgg tgaagatttc ttacaagggt
2641  actcctgcca tgcgtcgctc ccttgtcccc cagctacgga gtggcaaatt caatgtcctc
2701  ttgactactt atgagtatat tataaaagac aagcacattc ttgcaaagat tcggtggaaa
2761  tacatgatag tggacgaagg ccaccgaatg aagaatcacc actgcaagct gactcaggtg
2821  gacttaaatg aagaagaaac tatattgatc atcaggcgtc tacataaggt gttaagacca
2881  tttttactaa ggagactgaa gaaagaagtt gaatcccagc ttcccgaaaa agtggaatat
2941  gtgatcaagt gtgacatgtc agctctgcag aagattctgt atcgccatat gcaagccaag
3001  gggatccttc tcacagatgg ttctgagaaa gataagaagg ggaaaggagg tgctaagaca
```

TABLE 1-continued

```
3061  cttatgaaca ctattatgca gttgagaaaa atctgcaacc acccatatat gtttcagcac 3121  attgaggaat cctttgctga acacctaggc tattcaaatg gggtcatcaa tggggctgaa 3181  ctgtatcggg cctcagggaa gtttgagctg cttgatcgta ttctgccaaa attgagagcg 3241  actaatcacc gagtgctgct tttctgccag atgacatctc tcatgaccat catggaggat 3301  tattttgctt ttcggaactt cctttaccta cgccttgatg caccaccaa gtctgaagat 3361  cgtgctgctt tgctgaagaa attcaatgaa cctggatccc agtatttcat tttcttgctg 3421  agcacaagag ctggtggcct gggcttaaat cttcaggcag ctgatacagt ggtcatcttt 3481  gacagcgact ggaatcctca tcaggatctg caggcccaag accgagctca ccgcatcggg 3541  cagcagaacg aggtccgggt actgaggctc tgtaccgtga acagcgtgga ggaaaagatc 3601  ctcgcggccg caaaatacaa gctgaacgtg gatcagaaag tgatccaggc gggcatgttt 3661  gaccaaaagt cttcaagcca cgagcggagg gcattcctgc aggccatctt ggagcatgag 3721  gaggaaaatg aggaagaaga tgaagtaccg gacgatgaga ctctgaacca aatgattgct 3781  cgacgagaag aagaatttga cctttttatg cggatggaca tggaccggcg gagggaagat 3841  gcccggaacc cgaaacggaa gccccgttta atggaggagg atgagctgcc ctcctggatc 3901  attaaggatg acgctgaagt agaaaggctc acctgtgaag aagaggagga gaaaatattt 3961  gggaggggt cccgccagcg ccgtgacgtg gactacagtg acgccctcac ggagaagcag 4021  tggctaaggg ccatcgaaga cggcaatttg gaggaaatgg aagaggaagt acggcttaag 4081  aagcgaaaaa gacgaagaaa tgtggataaa gatcctgcaa agaagatgt ggaaaagct 4141  aagaagagaa gaggccgccc tcccgctgag aaactgtcac caaatccccc caaactgaca 4201  aagcagatga acgctatcat cgatactgtg ataaactaca agatagttc agggcgacag 4261  ctcagtgaag tcttcattca gttaccttca aggaaagaat taccagaata ctatgaatta 4321  attaggaagc cagtggattt caaaaaaata aaggaaagga ttcgtaatca taagtaccgg 4381  agcctaggcg acctggagaa ggatgtcatg cttctctgtc acaacgctca gacgttcaac 4441  ctggagggat cccagatcta tgaagactcc atcgtcttac agtcagtgtt taagagtgcc 4501  cggcagaaaa ttgccaaaga ggaagagagt gaggatgaaa gcaatgaaga ggaggaagag 4561  gaagatgaag aagagtcaga gtccgaggca aaatcagtca aggtgaaaat taagctcaat 4621  aaaaaagatg acaaaggccg ggacaaaggg aaaggcaaga aaaggccaaa tcgaggaaaa 4681  gccaaacctg tagtgagcga ttttgacagc gatgaggagc aggatgaacg tgaacagtca 4741  gaaggaagtg ggacggatga tgagtgatca gtatggacct tttttccttgg tagaactgaa 4801  ttccttcctc ccctgtctca tttctaccca gtgagttcat tgtcatata ggcactgggt 4861  tgtttctata tcatcatcgt ctataaacta gctttaggat agtgccagac aaacatatga 4921  tatcatggtg taaaaaacac acacatacac aaatatttgt aacatattgt gaccaaatgg 4981  gcctcaaaga ttcagattga aacaaacaaa aagcttttga tggaaaatat gtgggtggat 5041  agtatatttc tatgggtggg tctaatttgg taacggtttg attgtgcctg gttttatcac 5101  ctgttcagat gagaagattt ttgtcttttg tagcactgat aaccaggaga agccattaaa 5161  agccactggt tattttattt ttcatcaggc aattttcgag gtttttattt gttcggtatt 5221  gttttttttac actgtggtac atataagcaa ctttaatagg tgataaatgt acagtagtta 5281  gatttcacct gcatatacat ttttccattt tatgctctat gatctgaaca aaagcttttt 5341  gaattgtata agatttatgt ctactgtaaa cattgcttaa ttttttttgct cttgatttaa 5401  aaaaaagttt tgttgaaagc gctattgaat attgcaatct atatagtgta ttggatggct
```

TABLE 1-continued

```
5461  tcttttgtca ccctgatctc ctatgttacc aatgtgtatc gtctccttct ccctaaagtg
5521  tacttaatct tgctttctt tgcacaatgt ctttggttgc aagtcataag cctgaggcaa
5581  ataaaattcc agtaatttcg aagaatgtgg tgttggtgct ttcctaataa agaaataatt
5641  tagcttgaca aaaaaaaaaa aaaa
```

SEQ ID NO: 78 Human BRM Amino Acid Sequence Isoform C (NP_001276326.1)

```
   1  mstptdpgam phpgpspgpg pspgpilgps pgpgpspgsv hsmmgpspgp psyshpmptm
  61  gstdfpgegm hqmhkpidgi hdkgivedih cgsmkgtgmr pphpgmgppq spmdqhsqgy
 121  msphpsplga pehvsspmsg ggptppqmpp sqpgalipgd pqamsqpnrg pspfspvglh
 181  qlragilayk mlargqplpe tlglavqgkr tlpglqqqqq qqqqqqqqq qqqqqqqpq
 241  qqppqpqtqq qqqpalvnyn rpsgpgpels gpstpqklpv papggrpspa ppaaaqppaa
 301  avpgpsvpqp apgqpspvlq lqqkqsrisp iqkpqgldpv eilgereyrl gariahrige
 361  lenlpgslpp dlrtkatvel kalrllnfqr qlrgevvacm rrdttletal nskaykrskr
 421  qtlrearmte klekqqkieq erkrrqkhqe ylnsilqhak dfkeyhrsva gkiqklskav
 481  atwhantere qkketeriek ermrrlmaed eegyrklidq kkdrrlayll qqtdeyvanl
 541  tnlvwehkqa qaakekkkrr rrkkkaeena eggesalgpd gepidessqm sdlpvkvtht
 601  etgkvlfgpe apkasqldaw lemnpgyeva prsdseesds dyeeedeeee ssrqeteeki
 661  lldpnseevs ekdakqiiet akqdvddeys mgysargsgs yytvahaise rvekqsalli
 721  ngtlkhyqlq glewmvslyn nnlngilade mglgktiqti alitylmehk ringpyliiv
 781  plstlsnwty efdkwapsvv kisykgtpam rrslvpqlrs gkfnvlltty eyiikdkhil
 841  akirwkymiv deghrmknhh ckltqvdlne eetiliirrl hkvlrpfllr rlkkevesql
 901  pekveyvikc dmsalqkily rhmqakgill tdgsekdkkg kggaktlmnt imqlrkicnh
 961  pymfqhiees faehlgysng vingaelyra sgkfelldri lpklratnhr vllfcgmtsl
1021  mtimedyfaf rnflylrldg ttksedraal lkkfnepgsq yfiflllstra gglglnlqaa
1081  dtvvifdsdw nphqdlqaqd rahrigqgne vrvlrlctvn sveekilaaa kyklnvdqkv
1141  igagmfdqks ssherraflq aileheeene eedevpddet lnqmiarree efdlfmrmdm
1201  drrredarnp krkprlmeed elpswiikdd aeverltcee eeekifgrgs rqrrdvdysd
1261  altekqwlra iedgnleeme eevrlkkrkr rrnvdkdpak edvekakkrr grppaeklsp
1321  nppkltkqmn aiidtvinyk dssgrqlsev fiqlpsrkel peyyelirkp vdfkkikeri
1381  rnhkyrslgd lekdvmllch naqtfnlegs qiyedsivlq svfksarqki akeeesedes
1441  neeeeeedee eseseaksvk vkiklnkkdd kgrdkgkgkk rpnrgkakpv vsdfdsdeeq
1501  dereqsegsg tdde
```

SEQ ID NO: 79 Human BRM cDNA Sequence Variant 5 (NM_001289398.1, CDS: from 203 to 949)

```
   1  cttggagagg cggaggtgga aacgatgcgc aggagttggc ttgggctttt ttgtttgcgt
  61  gtccctgttt acctattcat aatcatggat cccctctgct tgtgatact gtgaaccacg
 121  cataacagca attctttaca ccaccgggtt gagaagaagg cgcctgaggc tgactttctg
 181  gacctgccgt cacgcagtaa agatgtggtt ggccatcgaa gacggcaatt tggaggaaat
 241  ggaagaggaa gtacggctta agaagcgaaa aagacgaaga aatgtggata agatcctgc
 301  aaaagaagat gtggaaaaag ctaagaagag aagaggccgc cctcccgctg agaaactgtc
 361  accaaatccc cccaaactga caaagcagat gaacgctatc atcgatactg tgataaacta
 421  caaagatagt tcagggcgac agctcagtga agtcttcatt cagttaccttt caaggaaaga
 481  attaccagaa tactatgaat taattaggaa gccagtggat ttcaaaaaaa taaaggaaag
```

TABLE 1-continued

```
 541 gattcgtaat cataagtacc ggagcctagg cgacctggag aaggatgtca tgcttctctg
 601 tcacaacgct cagacgttca acctggaggg atcccagatc tatgaagact ccatcgtctt
 661 acagtcagtg tttaagagtg cccggcagaa aattgccaaa gaggaagaga gtgaggatga
 721 aagcaatgaa gaggaggaag aggaagatga agaagagtca gagtccgagg caaaatcagt
 781 caaggtgaaa attaagctca ataaaaaaga tgacaaaggc cgggacaaag ggaaaggcaa
 841 gaaaaggcca atcgaggaa aagccaaacc tgtagtgagc gattttgaca gcgatgagga
 901 gcaggatgaa cgtgaacagt cagaaggaag tgggacggat gatgagtgat cagtatggac
 961 ctttttcctt ggtagaactg aattccttcc tcccctgtct catttctacc cagtgagttc
1021 atttgtcata taggcactgg gttgtttcta tatcatcatc gtctataaac tagctttagg
1081 atagtgccag acaaacatat gatatcatgg tgtaaaaaac acacacatac acaaatattt
1141 gtaacatatt gtgaccaaat gggcctcaaa gattcagatt gaaacaaaca aaaagctttt
1201 gatggaaaat atgtgggtgg atagtatatt tctatgggtg ggtctaattt ggtaacggtt
1261 tgattgtgcc tggttttatc acctgttcag atgagaagat ttttgtcttt tgtagcactg
1321 ataaccagga gaagccatta aaagccactg gttatttat ttttcatcag gcaattttcg
1381 aggtttttat ttgttcggta ttgttttttt acactgtggt acatataagc aactttaata
1441 ggtgataaat gtacagtagt tagatttcac ctgcatatac attttttccat tttatgctct
1501 atgatctgaa caaaagcttt ttgaattgta taagatttat gtctactgta aacattgctt
1561 aattttttg ctcttgattt aaaaaaaagt tttgttgaaa gcgctattga atattgcaat
1621 ctatatagtg tattggatgg cttcttttgt caccctgatc tcctatgtta ccaatgtgta
1681 tcgtctcctt ctccctaaag tgtacttaat ctttgctttc tttgcacaat gtctttggtt
1741 gcaagtcata agcctgaggc aaataaaatt ccagtaattt cgaagaatgt ggtgttggtg
1801 ctttcctaat aaagaaataa tttagcttga caaaaaaaaa aaaaaa
```

SEQ ID NO: 80 Human BRM Amino Acid Sequence Isoform D (NP_001276327.1)

```
   1 mwlaiedgnl eemeeevrlk krkrrrnvdk dpakedveka kkrrgrppae klspnppklt
  61 kqmnaiidtv inykdssgrq lsevfiqlps rkelpeyyel irkpvdfkki kerirnhkyr
 121 slgdlekdvm llchnagtfn legsqiyeds ivlqsvfksa rqkiakeees edesneeeee
 181 edeeesesea ksvkvkikln kkddkgrdkg kgkkrpnrgk akpvvsdfds deeqdereqs
 241 egsgtdde
```

SEQ ID NO: 81 Human BRM cDNA Sequence Variant 6 (NM_001289399.1, CDS: from 106 to 936)

```
   1 attcacttca ttaaatctag aggcagttga gcatgggagc cgtctgtatg ttgaattagg
  61 gctcgcactc ttgcgcaaca cgtcaccagt cggaaactgg ggctgatgaa gagactagca
 121 gctcgctgct ttgctggctt gttaatttta tccccactaa ctgtgatttc tgatagccgg
 181 cctgctgata gtggtaaggc catcgaagac ggcaatttgg aggaaatgga gaggaagta
 241 cggcttaaga agcgaaaaag acgaagaaat gtggataaag atcctgcaaa agaagatgtg
 301 gaaaaagcta agaagagaag aggccgccct cccgctgaga aactgtcacc aaatccccc
 361 aaactgacaa agcagatgaa cgctatcatc gatactgtga taaactacaa agatagttca
 421 gggcgacagc tcagtgaagt cttcattcag ttaccttcaa ggaaagaatt accagaatac
 481 tatgaattaa ttaggaagcc agtggatttc aaaaaaataa ggaaaggat tcgtaatcat
 541 aagtaccgga gcctaggcga cctggagaag gatgtcatgc ttctctgtca caacgctcag
 601 acgttcaacc tggagggatc ccagatctat gaagactcca tcgtcttaca gtcagtgttt
 661 aagagtgccc ggcagaaaat tgccaaagag gaagagagtg aggatgaaag caatgaagag
```

TABLE 1-continued

```
 721 gaggaagagg aagatgaaga agagtcagag tccgaggcaa atcagtcaa ggtgaaaatt
 781 aagctcaata aaaaagatga caaaggccgg acaaaggga aaggcaagaa aaggccaaat
 841 cgaggaaaag ccaaacctgt agtgagcgat tttgacagcg atgaggagca ggatgaacgt
 901 gaacagtcag aaggaagtgg acggatgatg agtgatcag tatggacctt tttccttggt
 961 agaactgaat tccttcctcc cctgtctcat ttctacccag tgagttcatt tgtcatatag
1021 gcactgggtt gtttctatat catcatcgtc tataaactag ctttaggata gtgccagaca
1081 aacatatgat atcatggtgt aaaaaacaca cacatacaca atatttgta acatattgtg
1141 accaaatggg cctcaaagat tcagattgaa acaaacaaaa agcttttgat ggaaaaatatg
1201 tgggtggata gtatatttct atgggtgggt ctaatttggt aacggtttga ttgtgcctgg
1261 ttttatcacc tgttcagatg agaagatttt tgtcttttgt agcactgata accaggagaa
1321 gccattaaaa gccactggtt atttttatttt tcatcaggca attttcgagg tttttatttg
1381 ttcggtattg ttttttttaca ctgtggtaca tataagcaac tttaataggt gataaatgta
1441 cagtagttag atttcacctg catatacatt tttccatttt atgctctatg atctgaacaa
1501 aagctttttg aattgtataa gatttatgtc tactgtaaac attgcttaat ttttttgctc
1561 ttgatttaaa aaaagttttt gttgaaagcg ctattgaata ttgcaatcta tatagtgtat
1621 tggatggctt cttttgtcac cctgatctcc tatgttacca atgtgtatcg tctccttctc
1681 cctaaagtgt acttaatctt tgctttcttt gcacaatgtc tttggttgca agtcataagc
1741 ctgaggcaaa taaaattcca gtaatttcga agaatgtggt gttggtgctt tcctaataaa
1801 gaaataattt agcttgacaa aaaaaaaaaa aaa
```

SEQ ID NO: 82 Human BRM Amino Acid Sequence Isoform E (NP_001276328.1)
```
   1 mkrlaarcfa gllilspltv isdsrpadsg kaiedgnlee meeevrlkkr krrrnvdkdp
  61 akedvekakk rrgrppaekl spnppkltkq mnaiidtvin ykdssgrqls evfiqlpsrk
 121 elpeyyelir kpvdfkkike rirnhkyrsl gdlekdvmll chnaqtfnle gsqiyedsiv
 181 lqsvfksarq kiakeeesed esneeeeeed eeeseseaks vkvkiklnkk ddkgrdkgkg
 241 kkrpnrgkak pvvsdfdsde egderegseg sgtdde
```

SEQ ID NO: 83 Human BRM cDNA Sequence Variant 7 (NM_001289400.1, CDS: from 521 to 1357)
```
   1 acttcattaa atctagaggc agttgagcat gggagccgtc tgtatgttga attagggctc
  61 gcactcttgc gcaacacgtc accagtcgga aactgggggt ttgcttctgt gatttatttc
 121 attattgtgc tggtaaaagg tttggaaggg aattcttttt gggggtagta ctttagcatt
 181 gtgtagcaag ttttgggggtt tttttgtgt gtgacccccc agcccccagc gctgagtttg
 241 agtcagttga gccagtttag taaataattt tttaaaataa agaacagtt taaaatctcc
 301 atgaataatt ttacttacat gcaggagtaa tcttactcta ctctttatgt gcgaaaagca
 361 ttgggaagtg tttagtgaat tgatttccat tagaaaaaga cccttagaaa tcacagaaca
 421 taaagcactg catatggatg tgtttggggt cttggggag gagggaagat gttttgtagc
 481 tctctgcatt cctgcataaa accttagttt gaggggaata atgctgatga agagactagc
 541 agctcgctgc tttgctggct tgttaatttt atccccacta actgtgattt ctgatagccg
 601 gcctgctgat agtggtaagg ccatcgaaga cggcaatttg gaggaaatgg aagaggaagt
 661 acggcttaag aagcgaaaaa gacgaagaaa tgtggataaa gatcctgcaa agaagatgt
 721 ggaaaaagct aagaagagaa gaggccgccc tccgctgag aaactgtcac caaatccccc
 781 caaactgaca aagcagatga acgctatcat cgatactgtg ataaactaca agatagttc
 841 agggcgacag ctcagtgaag tcttcattca gttaccttca aggaaagaat taccagaata
```

TABLE 1-continued

```
 901  ctatgaatta attaggaagc cagtggattt caaaaaaata aaggaaagga ttcgtaatca
 961  taagtaccgg agcctaggcg acctggagaa ggatgtcatg cttctctgtc acaacgctca
1021  gacgttcaac ctggagggat cccagatcta tgaagactcc atcgtcttac agtcagtgtt
1081  taagagtgcc cggcagaaaa ttgccaaaga ggaagagagt gaggatgaaa gcaatgaaga
1141  ggaggaagag gaagatgaag aagagtcaga gtccgaggca aaatcagtca aggtgaaaat
1201  taagctcaat aaaaaagatg acaaaggccg gacaaaggg aaaggcaaga aaaggccaaa
1261  tcgaggaaaa gccaaacctg tagtgagcga ttttgacagc gatgaggagc aggatgaacg
1321  tgaacagtca gaaggaagtg ggacggatga tgagtgatca gtatggacct ttttccttgg
1381  tagaactgaa ttccttcctc ccctgtctca tttctaccca gtgagttcat tgtcatata
1441  ggcactgggt tgtttctata tcatcatcgt ctataaacta gctttaggat agtgccagac
1501  aaacatatga tatcatggtg taaaaaacac acacatacac aaatatttgt aacatattgt
1561  gaccaaatgg gcctcaaaga ttcagattga aacaaacaaa aagcttttga tggaaaatat
1621  gtgggtggat agtatatttc tatgggtggg tctaatttgg taacggtttg attgtgcctg
1681  gttttatcac ctgttcagat gagaagattt ttgtcttttg tagcactgat aaccaggaga
1741  agccattaaa agccactggt tattttattt ttcatcaggc aattttcgag gttttttattt
1801  gttcggtatt gttttttac actgtggtac atataagcaa ctttaatagg tgataaatgt
1861  acagtagtta gatttcacct gcatatacat ttttccattt tatgctctat gatctgaaca
1921  aaagcttttt gaattgtata agatttatgt ctactgtaaa cattgcttaa ttttttgct
1981  cttgatttaa aaaaagttt tgttgaaagc gctattgaat attgcaatct atatagtgta
2041  ttggatggct tcttttgtca ccctgatctc ctatgttacc aatgtgtatc gtctccttct
2101  ccctaaagtg tacttaatct ttgctttctt tgcacaatgt ctttggttgc aagtcataag
2161  cctgaggcaa ataaaattcc agtaatttcg aagaatgtgg tgttggtgct ttcctaataa
2221  agaaataatt tagcttgaca aaaaaaaaaa aaaa
```

SEQ ID NO: 84 Human BRM Amino Acid Sequence Isoform F (NP_001276329.1)
```
   1  mlmkrlaarc fagllilspl tvisdsrpad sgkaiedgnl eemeeevrlk krkrrrnvdk
  61  dpakedveka kkrrgrppae klspnppklt kqmnaiidtv inykdssgrq lsevfiqlps
 121  rkelpeyyel irkpvdfkki kerirnhkyr slgdlekdvm llchnagtfn legsqiyeds
 181  ivlqsvfksa rqkiakeees edesneeeee edeeesesea ksvkvkikln kkddkgrdkg
 241  kgkkrpnrgk akpvvsdfds deeqdereqs egsgtdde
```

SEQ ID NO: 85 Mouse BRM cDNA Sequence Variant 1 (NM_011416.2, CDS: from 111 to 4862)
```
   1  ctcgctccct ctgtttctgt actctgggtg actcagagag ggaagattca gccagcacac
  61  tgctcgcgag caagtgtcac tctgctaact ggcagagcca ggagacctag atgtccacac
 121  ccacagaccc agcagcaatg cccatcctg ggccctcccc ggggcctgga ccctctcctg
 181  gaccaattct ggggcctagt ccaggaccag gaccatcccc aggttctgtg cacagcatga
 241  tgggtcctag tcccggacct cccagcgtct cacatcctct gtcaacgatg ggctctgcag
 301  acttcccaca ggaaggcatg caccaattac ataagcccat ggatgggata catgacaaag
 361  ggattgtaga agatgtccac tgtggatcca tgaagggcac cagcatgcgc ccccacacc
 421  caggaatggg ccctccacag agccccatgg accagcacag ccaaggttat atgtcaccac
 481  atccgtctcc tctgggagcc ccggagcacg tctctagccc tatatctgga ggaggcccaa
 541  ccccaccca gatgccaccg agccagccag gggcactcat cccaggagat ccgcaggcca
 601  tgaaccagcc taacagaggt ccctcgcctt tcagtcctgt gcagctgcat cagcttcgag
```

TABLE 1-continued

```
 661  ctcagatttt agcttacaaa atgttggcca ggggccagcc tctccctgaa actctgcagc
 721  tggcagtcca gggaaaaagg accttgcctg gcatgcagca gcagcagcag caacaacaac
 781  aacagcagca gcagcagcag cagcagcagc agcaacagca gcaacaacag cagccccagc
 841  agcctcagca gcaggctcag gcacagcccc agcagcagca gcaacagcag cagcagccag
 901  ctcttgttag ctataatcga ccatctggcc ccgggcagga gctgctactg agtggccaga
 961  gcgctccgca gaagctgtca gcaccagcac caagcggccg accttcaccg gcacccaggg
1021  ccgccgtcca gcccacggcc acagcggtgc ccgggccctc cgtgcagcag cccgccccag
1081  ggcagccgtc tccggtccta cagctgcaac agaagcagag ccgcatcagc cccatccaga
1141  aaccgcaagg cctggacccg gtggagatcc tgcaggaacg agagtacaga cttcaagctc
1201  gcatcgctca taggatacaa gaactggaaa gtctgcctgg ttccttgcca ccagatttac
1261  gcaccaaagc aaccgtggaa ctgaaagcac ttcgcttact caacttccaa cgtcagctga
1321  gacaggaggt ggtggcctgc atgcggaggg acaccaccct ggagacggcc ctcaactcca
1381  aagcatataa gcggagcaag cgccagaccc tgcgtgaggc acgcatgaca gagaaactgg
1441  agaagcagca gaagatagaa caggagagga aacgccggca gaaacaccag gaatacctga
1501  acagtatttt gcaacatgca aaagatttta aggaatatca ccggtctgtg gccgggaaga
1561  tccagaagct ctccaaagca gtggcgactt ggcatgctaa cacagaaagg gagcagaaga
1621  aggagacgga gcggatcgag aaggagagaa tgcggaggct gatggccgaa gatgaagagg
1681  gctacaggaa gcttattgac aaaagaaag acagacgtct cgcctaccta ttgcagcaga
1741  ccgatgagta tgtcgccaat ctgaccaacc tggtgtggga gcacaagcag gcccaagcag
1801  ccaaagagaa gaagaagagg aggaggagga agaagaaggc tgaagagaat gcagagggag
1861  gggaacctgc cctgggacca gatggagagc aatagatga aagcagccag atgagtgacc
1921  tgcctgtcaa agtgacacac acagaaactg gcaaggtcct ctttggacca gaagcaccca
1981  aagcaagtca gctggatgcc tggctggaga tgaatcctgg ttacgaagtt gcacccagat
2041  ctgacagtga agagagtgaa tcggactacg aggaggagga tgaagaagaa gagtccagta
2101  ggcaggaaac cgaggagaag atactgctgg atcccaacag tgaagaagtt tccgaaaagg
2161  atgccaagca gatcattgag actgcgaagc aggacgtgga cgacgaatac agcatgcagt
2221  acagtgccag aggctctcag tcctactaca cggtggctca cgctatctct gagagggtgg
2281  agaagcagtc tgccctcctc attaacggca ccctaaagca ttaccagctc cagggcctgg
2341  aatggatggt ttccctgtat aataacaatc tgaacggaat cttagctgat gaaatggggc
2401  taggcaagac catccagacc attgcactca tcacgtatct gatggagcac aaaaggctca
2461  atggtcccta cctcatcatc gtccccctct cgactctgtc taactggaca tatgaatttg
2521  acaaatgggc tccttctgtg gtgaaaattt cttacaaggg taccccctgcc atgcgacgct
2581  ccctcgttcc ccagctacgg agtggcaaat tcaatgtcct cctgactact tacgagtaca
2641  ttataaaaga caagcacatt cttgcaaaga ttcggtggaa gtacatgatc gtggacgaag
2701  gccaccggat gaagaatcac cactgcaagc taacccaggt cctgaacaca cactatgtgg
2761  cccccaggcg gatccttctg actgggaccc cactgcagaa taagcttccg gaactctggg
2821  ccctcctcaa cttcctcctc cctacaatct tcaagagttg cagcacattt gagcagtggt
2881  ttaatgctcc attttgccatg accggtgaaa gggtggacct gaacgaagaa gaaacgattt
2941  tgatcatcag gcgtctacac aaggtgctga cccctttttt actgaggagg ctgaagaaag
3001  aggttgagtc tcagcttccg gaaaaggttg agtatgtgat caagtgtgac atgtcagctc
```

TABLE 1-continued

```
3061  tgcagaagat tctgtaccgt cacatgcaag ccaaggggat cctcctcacg gacgggtctg
3121  agaaagataa gaaggggaaa ggaggtgcca agacacttat gaacaccatc atgcagctga
3181  gaaaaatatg caaccaccca tatatgtttc agcacattga ggaatccttt gctgaacacc
3241  tgggctattc gaatggggtc atcaatgggg ctgagctgta tcgggcctcg ggaaagtttg
3301  agctgcttga tcgtattctg cccaaattga gagcgactaa ccaccgcgtg ctgcttttct
3361  gccagatgac gtcactcatg accattatgg aggattactt tgcttttcgg aacttcctgt
3421  acctgcgcct tgacggcacc accaagtctg aagatcgtgc tgctttgcta agaaaattca
3481  atgaacctgg gtcccagtat ttcattttct tgctgagcac aagagcaggg ggcctgggct
3541  taaatcttca ggcggcagac acggtggtca tatttgacag cgactggaat cctcaccagg
3601  atctgcaggc ccaagaccga gctcaccgca ttggccaaca aaacgaggtc cgggtgctga
3661  ggctttgcac cgtcaacagt gtggaggaaa agattctcgc ggctgccaag tacaagctga
3721  acgtggatca gaaggttatc caagcaggca tgtttgacca gaagtcatcc agccacgagc
3781  ggagggcctt cctgcaggcc attctggagc acgaggagga gaatgaggaa gaagatgagg
3841  taccagacga cgagaccctg aaccagatga ttgctcgccg ggaggaagaa tttgatcttt
3901  ttatgcgcat ggacatggac cggcggaggg aggatgcccg gaacccgaag cgcaaacccc
3961  gcttgatgga ggaagatgag ctgccctcct ggattatcaa ggatgacgcc gaagtggaaa
4021  ggctcacctg tgaagaagag gaggagaaga tatttgggag gggctctcgc cagcgccggg
4081  atgtggacta cagtgatgcc ctcaccgaga gcaatggct cagggccatc gaagacggca
4141  atttggaaga aatggaagag gaggtacggc ttaagaagag aaaaagacga agaaatgtgg
4201  ataaagaccc cgtgaaggaa gatgtggaaa agcgaagaa aagaagaggc cgccctccgg
4261  ctgagaagtt gtcaccaaat cccccaaaac taacgaagca gatgaacgcc atcattgata
4321  ctgtgataaa ctacaaagac agttcagggc gacagctcag tgaagtcttc attcagttac
4381  cttccaggaa agacttacca gaatactatg aattaattag gaagccagtg gatttcaaaa
4441  agataaagga gcgaatccgt aatcataagt atcggagcct gggagacctg gagaaagacg
4501  tcatgcttct ctgtcacaac gcacagacat tcaacttgga aggatcccag atctacgaag
4561  actccattgt cctacagtca gtgtttaaga gtgctcggca gaaaattgcc aaagaagaag
4621  agagtgagga agaaagcaat gaagaagagg aagaagatga tgaagaggag tcggagtcag
4681  aggcgaaatc tgtgaaggtg aaaatcaagc tgaataaaaa ggaagagaaa ggccgggaca
4741  cagggaaggg caagaagcgg ccaaaccgag gcaaagccaa acccgtcgtg agcgattttg
4801  acagtgacga ggaacaggaa gagaacgaac agtcagaagc aagtggaact gataacgagt
4861  gaccatcctg gacgtgagct tcccgcggtg gcagaaccga atgctttctt ccccctctcc
4921  ttcctcccca gtgagttcac ttgccattcg ggcacactgg gttatttctc cgtcctcatt
4981  gtcatctaga actagcttta gggtagtgcc agacaaacat atgatatcat ggtgtaaaaa
5041  aagaaacaca tgcgtgcaga cacactacac acacacacac acacacacac acacacacac
5101  acacatattt gtaacatatt gtgaccaaat gggcctcaaa gattcaaaga ttaaaaacaa
5161  aaagctttg atggaaaaga tgtgggtgga tagtatattt ctacaggtgg gtcaggtttg
5221  gtagcagttt gatgtgctgg gttctgtcat ctgttctgat gagaagattt ttatcttctg
5281  cagtgctgat ggccgggagg aaccattcaa agccactggt tatttgtttt tcatcaggc
5341  gattttcaag attttcattt gtttcagtat tgttggtttt ctcttttctc ttttttacac
5401  tgtggtacat ataagcaact tgactagtga caaatgtaca gtagttagat atcacctaca
```

TABLE 1-continued

```
5461 tatacatttt tccattttat gctctatgat ctgaagaaca aaaaaaaaag cttttgact
5521 tgtataagat ttatgtctac tgtaaacatt gcggaatttt ttttgttct tgttttattg
5581 acaatgctat tgagtattac agtgtctaga ataccctgga tggcttctct tgtccacccg
5641 atctcccgtg ttaccaatgt gtatggtctc cttctcccga aagtgtactt aatctttgct
5701 ttctttgcac aatgtctttg gttgcaagtc ataagcctga ggcaaataaa attccagtaa
5761 tttccaagaa tgtggtgttg gtactttcct aataaaccga taacgtacct tgaaaaaaaa
5821 aaaaaaaaaa a
```

SEQ ID NO: 86 Mouse BRM Amino Acid Sequence Isoform A (NP_035546.2)

```
   1 mstptdpaam phpgpspgpg pspgpilgps pgpgpspgsv hsmmgpspgp psyshplstm
  61 gsadfpgegm hqlhkpmdgi hdkgivedvh cgsmkgtsmr pphpgmgppq spmdqhsqgy
 121 msphpsplga pehvsspisg ggptppqmpp sqpgalipgd pqamnqpnrg pspfspvglh
 181 qlragilayk mlargqplpe tlglavqgkr tlpgmqqqqq qqqqqqqqq qqqqqqqqq
 241 qpqqpqqqaq aqpqqqqqqq qqpalvsynr psgpggelll sgqsapqkls apapsgrpsp
 301 apqaavqpta tavpgpsvgq papgqpspvl qlqqkgsris piqkpqgldp veilqereyr
 361 lgariahriq eleslpgslp pdlrtkatve lkalrllnfq rqlrgevvac mrrdttleta
 421 lnskaykrsk rqtlrearmt eklekqqkie gerkrrqkhq eylnsilqha kdfkeyhrsv
 481 agkiqklska vatwhanter eqkketerie kermrrlmae deegyrklid qkkdrrlayl
 541 lqqtdeyvan ltnlvwehkq aqaakekkkr rrrkkkaeen aeggepalgp dgepidessq
 601 msdlpvkvth tetgkvlfgp eapkasqlda wlemnpgyev aprsdseese sdyeeedeee
 661 essrqeteek illdpnseev sekdakqiie takqdvddey smqysargsq syytvahais
 721 ervekqsall ingtlkhyql qglewmvsly nnnlngilad emglgktiqt ialitylmeh
 781 kringpylii vplstlsnwt yefdkwapsv vkisykgtpa mrrslvpqlr sgkfnvlltt
 841 yeyiikdkhi lakirwkymi vdeghrmknh hckltqvint hyvaprrill tgtplqnklp
 901 elwallnfll ptifkscstf eqwfnapfam tgervdlnee etiliirrlh kvlrpfllrr
 961 lkkevesqlp ekveyvikcd msalqkilyr hmqakgillt dgsekdkkgk ggaktlmnti
1021 mqlrkicnhp ymfqhieesf aehlgysngv ingaelyras gkfelldril pklratnhry
1081 llfcgmtslm timedyfafr nflylrldgt tksedraall kkfnepgsqy fifllstrag
1141 glglnlqaad tvvifdsdwn phqdlqaqdr ahrigqgnev rvlrlctvns veekilaaak
1201 yklnvdqkvi qagmfdqkss sherraflqa ileheeenee edevpddetl nqmiarreee
1261 fdlfmrmdmd rrredarnpk rkprlmeede lpswiikdda everltceee eekifgrgsr
1321 qrrdvdysda ltekqwlrai edgnleemee evrlkkrkrr rnvdkdpvke dvekakkrrg
1381 rppaeklspn ppkltkqmna iidtvinykd ssgrqlsevf iqlpsrkdlp eyyelirkpv
1441 dfkkikerir nhkyrslgdl ekdvmllchn aqtfnlegsq iyedsivlqs vfksarqkia
1501 keeeseeesn eeeeeddeee seseaksvkv kiklnkkeek grdtgkgkkr pnrgkakpvv
1561 sdfdsdeeqe eneqseasgt dne
```

SEQ ID NO: 87 Mouse BRM cDNA Sequence Variant 2 (NM_026003.2, CDS: from 301 to 1011)

```
   1 ttcacttcat taaatctaga ggcggttcag catgggagcc gtctgtatgt tgaattaggg
  61 ctcgctctct tgcgcaacac gtcaccagtc ggaaactggg ggtttgcttc tgtgatttat
 121 ttcattattg tgctggtaaa agctgatgaa gagactagca gctcgctgct ttgccggctt
 181 gttaatttta tccccactaa ctgtgatttc cgatagccgg cctgctgata gtggtaagtg
 241 cggctggctc tggtttaaag caagcgtttg caggccatcg aagacggcaa tttggaagaa
```

TABLE 1-continued

```
 301   atggaagagg aggtacggct taagaagaga aaaagacgaa gaaatgtgga taaagacccc
 361   gtgaaggaag atgtggaaaa agcgaagaaa agaagaggcc gccctccggc tgaaaagttg
 421   tcaccaaatc ccccaaaact aacgaagcag atgaacgcca tcattgatac tgtgataaac
 481   tacaaagaca gttcagggcg acagctcagt gaagtcttca ttcagttacc ttccaggaaa
 541   gacttaccag aatactatga attaattagg aagccagtgg atttcaaaaa gataaaggag
 601   cgaatccgta atcataagta tcggagcctg ggagacctgg agaaagacgt catgcttctc
 661   tgtcacaacg cacagacatt caacttggaa ggatcccaga tctacgaaga ctccattgtc
 721   ctacagtcag tgtttaagag tgctcggcaa aaaattgcca agaagaaga gagtgaggaa
 781   gaaagcaatg aagaagagga agaagatgat gaagaggagt cggagtcaga ggcgaaatct
 841   gtgaaggtga aaatcaagct gaataaaaag gaagagaaag gccgggacac agggaagggc
 901   aagaagcggc caaaccgagg caaagccaaa cccgtcgtga gcgattttga cagtgacgag
 961   gaacaggaag agaacgaaca gtcagaagca agtggaactg ataacgagtg accatcctgg
1021   acgtgagctt cccgcggtgg cagaaccgaa tgctttcttc cccctctcct tcctccccag
1081   tgagttcact tgccattcgg gcacactggg ttatttctcc gtcctcattg tcatctagaa
1141   ctagctttag ggtagtgcca gacaaacata tgatatcatg tgtaaaaaa agaaacacat
1201   gcgtgcagac acactacaca cacacacaca cacacacaca cacacacaca cacatatttg
1261   taacatattg tgaccaaatg ggcctcaaag attcaaagat taaaaacaaa aagcttttga
1321   tggaaaagat gtgggtggat agtatatttc tacaggtggg tcaggtttgg tagcagtttg
1381   atgtgctggg ttctgtcatc tgttctgatg agaagatttt tatcttctgc agtgctgatg
1441   gccgggagga accattcaaa gccactggtt atttttgtttt tcatcaggcg attttcaaga
1501   ttttcatttg tttcagtatt gttggttttc tcttttctct tttttacact gtggtacata
1561   taagcaactt gactagtgac aaatgtacag tagttagata tcacctacat atacattttt
1621   ccattttatg ctctatgatc tgaagaacaa aaaaaaaagc ttttttgactt gtataagatt
1681   tatgtctact gtaaacattg cggaattttt ttttgttctt gttttattga caatgctatt
1741   gagtattaca gtgtctagaa taccctggat ggcttctctt gtccacccga tctcccgtgt
1801   taccaatgtg tatggtctcc ttctcccgaa agtgtactta atctttgctt tctttgcaca
1861   atgtctttgg ttgcaagtca taagcctgag gcaaataaaa ttccagtaat tccaagaat
1921   gtggtgttgg tactttccta ataaaccgat aacgtacctt gaaa
```

SEQ ID NO: 88 Mouse BRM Amino Acid Sequence Isoform B (NP_080279.1)
```
  1    meeevrlkkr krrrnvdkdp vkedvekakk rrgrppaekl spnppkltkq mnaiidtvin
 61    ykdssgrqls evfiqlpsrk dlpeyyelir kpvdfkkike rirnhkyrsl gdlekdvmll
121    chnaqtfnle gsqiyedsiv lqsvfksarq kiakeeesee esneeeeedd eeeseseaks
181    vkvkiklnkk eekgrdtgkg kkrpnrgkak pvvsdfdsde egeenegsea sgtdne
```

SEQ ID NO: 89 Mouse BRM cDNA Sequence Variant 3 (NM_001347439.1, CDS:
from 180 to 1010)
```
  1    acacacacac acacacacac acgcaggctg aagtatgctt aactctttta acttggctgg
 61    ggcttttag caccatatgg ttcttttcgt gacgtccgga cccgaaagag tgcagtgtgc
121    cttttaaggaa agaggtacct caccaaactt ccctgtagtt gtgcctcacc atttagctga
181    tgaagagact agcagctcgc tgctttgccg gcttgttaat tttatcccca ctaactgtga
241    tttccgatag ccggcctgct gatagtggta aggccatcga agacggcaat ttggaagaaa
301    tggaagagga ggtacggctt aagaagagaa aaagacgaag aaatgtggat aaagaccccg
361    tgaaggaaga tgtggaaaaa gcgaagaaaa gaagaggccg ccctccggct gagaagttgt
```

TABLE 1-continued

```
 421  caccaaatcc cccaaaacta acgaagcaga tgaacgccat cattgatact gtgataaact
 481  acaaagacag ttcagggcga cagctcagtg aagtcttcat tcagttacct tccaggaaag
 541  acttaccaga atactatgaa ttaattagga agccagtgga tttcaaaaag ataaaggagc
 601  gaatccgtaa tcataagtat cggagcctgg gagacctgga gaaagacgtc atgcttctct
 661  gtcacaacgc acagacattc aacttggaag gatcccagat ctacgaagac tccattgtcc
 721  tacagtcagt gtttaagagt gctcggcaga aaattgccaa agaagaagag agtgaggaag
 781  aaagcaatga agaagaggaa gaagatgatg aagaggagtc ggagtcagag gcgaaatctg
 841  tgaaggtgaa aatcaagctg aataaaaagg aagagaaagg ccgggacaca gggaagggca
 901  agaagcggcc aaaccgaggc aaagccaaac ccgtcgtgag cgattttgac agtgacgagg
 961  aacaggaaga gaacgaacag tcagaagcaa gtggaactga taacgagtga ccatcctgga
1021  cgtgagcttc cgcggtggc agaaccgaat gctttcttcc ccctctcctt cctccccagt
1081  gagttcactt gccattcggg cacactgggt tatttctccg tcctcattgt catctagaac
1141  tagctttagg gtagtgccag acaaacatat gatatcatgg tgtaaaaaaa gaaacacatg
1201  cgtgcagaca cactacacac acacacacac acacacacac acacacacac acatatttgt
1261  aacatattgt gaccaaatgg gcctcaaaga ttcaaagatt aaaaacaaaa agcttttgat
1321  ggaaaagatg tgggtggata gtatatttct acaggtgggt caggtttggt agcagtttga
1381  tgtgctgggt tctgtcatct gttctgatga aagattttt atcttctgca gtgctgatgg
1441  ccgggaggaa ccattcaaag ccactggtta ttttgttttt catcaggcga ttttcaagat
1501  tttcatttgt ttcagtattg ttggttttct cttttctctt ttttacactg tggtacatat
1561  aagcaacttg actagtgaca aatgtacagt agttagatat cacctacata tacatttttc
1621  cattttatgc tctatgatct gaagaacaaa aaaaaaagct ttttgacttg tataagattt
1681  atgtctactg taaacattgc ggaattttt tttgttcttg ttttattgac aatgctattg
1741  agtattacag tgtctagaat accctggatg gcttctcttg tccacccgat ctcccgtgtt
1801  accaatgtgt atggtctcct tctcccgaaa gtgtacttaa tctttgcttt ctttgcacaa
1861  tgtctttggt tgcaagtcat aagcctgagg caaataaaat tccagtaatt tccaagaatg
1921  tggtgttggt actttcctaa taaaccgata acgtaccttg aaaaaaaaaa aaaaaaaaa
```

SEQ ID NO: 90 Mouse BRM Amino Acid Sequence Isoform C (NP_001334368.1)
```
  1  mkrlaarcfa gllilspltv isdsrpadsg kaiedgnlee meeevrlkkr krrrnvdkdp
 61  vkedvekakk rrgrppaekl spnppkltkq mnaiidtvin ykdssgrqls evfiqlpsrk
121  dlpeyyelir kpvdfkkike rirnhkyrsl gdlekdvmll chnaqtfnle gsqiyedsiv
181  lqsvfksarq kiakeeesee esneeeeedd eeeseseaks vkvkiklnkk eekgrdtgkg
241  kkrpnrgkak pvvsdfdsde egeeneqsea sgtdne
```

SEQ ID NO: 91 Human EGFR cDNA Sequence Variant 1 (NM_005228.4, CDS: from 258 to 3890)
```
  1  gtccgggcag ccccggcgc agcgcggccc cagcagcctc cgccccccgc acggtgtgag
 61  cgcccgacgc ggccgaggcg gccggagtcc cgagctagcc cggcggccg ccgccgccca
121  gaccggacga caggccacct cgtcggcgtc cgcccgagtc cccgcctcgc cgccaacgcc
181  acaaccaccg cgcacggccc cctgactccg tccagtattg atcgggagag ccggagcgag
241  ctcttcgggg agcagcgatg cgaccctccg gacggccgg ggcagcgctc tggcgctgc
301  tggctgcgct ctgcccggcg agtcgggctc tggaggaaaa gaaagtttgc caaggcacga
361  gtaacaagct cacgcagttg ggcacttttg aagatcattt tctcagcctc cagaggatgt
421  tcaataactg tgaggtggtc cttgggaatt tggaaattac ctatgtgcag aggaattatg
```

TABLE 1-continued

```
 481  atctttcctt cttaaagacc atccaggagg tggctggtta tgtcctcatt gccctcaaca
 541  cagtgggagcg aattcctttg gaaaacctgc agatcatcag aggaaatatg tactacgaaa
 601  attcctatgc cttagcagtc ttatctaact atgatgcaaa taaaaccgga ctgaaggagc
 661  tgcccatgag aaatttacag gaaatcctgc atggcgccgt gcggttcagc aacaaccctg
 721  ccctgtgcaa cgtggagagc atccagtggc gggacatagt cagcagtgac tttctcagca
 781  acatgtcgat ggacttccag aaccacctgg gcagctgcca aaagtgtgat ccaagctgtc
 841  ccaatgggag ctgctggggt gcaggagagg agaactgcca gaaactgacc aaaatcatct
 901  gtgcccagca gtgctccggg cgctgccgtg gcaagtcccc cagtgactgc tgccacaacc
 961  agtgtgctgc aggctgcaca ggcccccggg agagcgactg cctggtctgc cgcaaattcc
1021  gagacgaagc cacgtgcaag gacacctgcc cccactcat gctctacaac cccaccacgt
1081  accagatgga tgtgaacccc gagggcaaat acagctttgg tgccacctgc gtgaagaagt
1141  gtccccgtaa ttatgtggtg acagatcacg gctcgtgcgt ccgagcctgt ggggccgaca
1201  gctatgagat ggaggaagac ggcgtccgca agtgtaagaa gtgcgaaggg ccttgccgca
1261  aagtgtgtaa cggaataggt attggtgaat ttaaagactc actctccata aatgctacga
1321  atattaaaca cttcaaaaac tgcacctcca tcagtggcga tctccacatc ctgccggtgg
1381  catttagggg tgactccttc acacatactc ctcctctgga tccacaggaa ctggatattc
1441  tgaaaaccgt aaaggaaatc acagggtttt tgctgattca ggcttggcct gaaaacagga
1501  cggacctcca tgcctttgag aacctagaaa tcatacgcgg caggaccaag caacatggtc
1561  agttttctct tgcagtcgtc agcctgaaca taacatcctt gggattacgc tccctcaagg
1621  agataagtga tggagatgtg ataatttcag gaaacaaaaa tttgtgctat gcaaatacaa
1681  taaactggaa aaaactgttt gggacctccg gtcagaaaac caaaattata agcaacagag
1741  gtgaaaacag ctgcaaggcc acaggccagg tctgccatgc cttgtgctcc cccgagggct
1801  gctggggccc ggagcccagg gactgcgtct cttgccggaa tgtcagccga ggcagggaat
1861  gcgtggacaa gtgcaaccttt ctggagggtg agccaaggga gtttgtggag aactctgagt
1921  gcatacagtg ccacccagag tgcctgcctc aggccatgaa catcacctgc acaggacggg
1981  gaccagacaa ctgtatccag tgtgcccact acattgacgg ccccactgc gtcaagacct
2041  gcccggcagg agtcatggga gaaaacaaca ccctggtctg gaagtacgca gacgccggcc
2101  atgtgtgcca cctgtgccat ccaaactgca cctacggatg cactgggcca ggtcttgaag
2161  gctgtccaac gaatgggcct aagatcccgt ccatcgccac tgggatggtg ggggcctcc
2221  tcttgctgct ggtggtggcc ctggggatcg gcctcttcat gcgaaggcgc cacatcgttc
2281  ggaagcgcac gctgcggagg ctgctgcagg agagggagct tgtggagcct cttacaccca
2341  gtggagaagc tcccaaccaa gctctcttga ggatcttgaa ggaaactgaa ttcaaaaaga
2401  tcaaagtgct gggctccggt gcgttcggca cggtgtataa gggactctgg atcccagaag
2461  gtgagaaagt taaaattccc gtcgctatca aggaattaag agaagcaaca tctccgaaag
2521  ccaacaagga aatcctcgat gaagcctacg tgatggccag cgtggacaac ccccacgtgt
2581  gccgcctgct gggcatctgc ctcacctcca ccgtgcagct catcacgcag ctcatgccct
2641  tcggctgcct cctggactat gtccgggaac acaaagacaa tattggctcc cagtacctgc
2701  tcaactggtg tgtgcagatc gcaaagggca tgaactactt ggaggaccgt cgcttggtgc
2761  accgcgacct ggcagccagg aacgtactgg tgaaaacacc gcagcatgtc aagatcacag
2821  attttgggct ggccaaactg ctgggtgcgg aagagaaaga ataccatgca gaaggaggca
```

TABLE 1-continued

```
2881  aagtgcctat caagtggatg gcattggaat caattttaca cagaatctat acccaccaga
2941  gtgatgtctg gagctacggg gtgactgttt gggagttgat gacctttgga tccaagccat
3001  atgacggaat ccctgccagc gagatctcct ccatcctgga gaaaggagaa cgcctccctc
3061  agccacccat atgtaccatc gatgtctaca tgatcatggt caagtgctgg atgatagacg
3121  cagatagtcg cccaaagttc cgtgagttga tcatcgaatt ctccaaaatg ccccgagacc
3181  cccagcgcta ccttgtcatt caggggggatg aaagaatgca tttgccaagt cctacagact
3241  ccaacttcta ccgtgccctg atggatgaag aagacatgga cgacgtggtg gatgccgacg
3301  agtacctcat cccacagcag ggcttcttca gcagcccctc cacgtcacgg actccctcc
3361  tgagctctct gagtgcaacc agcaacaatt ccaccgtggc ttgcattgat agaaatgggc
3421  tgcaaagctg tcccatcaag gaagacagct tcttgcagcg atacagctca gacccccacag
3481  gcgccttgac tgaggacagc atagacgaca ccttcctccc agtgcctgaa tacataaacc
3541  agtccgttcc caaaaggccc gctggctctg tgcagaatcc tgtctatcac aatcagcctc
3601  tgaacccgc gcccagcaga gacccacact accaggaccc ccacagcact gcagtgggca
3661  accccgagta tctcaacact gtccagccca cctgtgtcaa cagcacattc gacagccctg
3721  cccactgggc ccagaaaggc agccaccaaa ttagcctgga caaccctgac taccagcagg
3781  acttctttcc caaggaagcc aagccaaatg gcatctttaa gggctccaca gctgaaaatg
3841  cagaatacct aagggtcgcg ccacaaagca gtgaattat tggagcatga ccacggagga
3901  tagtatgagc cctaaaaatc cagactcttt cgatacccag gaccaagcca cagcaggtcc
3961  tccatcccaa cagccatgcc cgcattagct cttagaccca cagactggtt ttgcaacgtt
4021  tacaccgact agccaggaag tacttccacc tcgggcacat tttgggaagt tgcattcctt
4081  tgtcttcaaa ctgtgaagca tttacagaaa cgcatccagc aagaatattg tcccttgag
4141  cagaaattta tctttcaaag aggtatattt gaaaaaaaaa aaaagtatat gtgaggattt
4201  ttattgattg gggatcttgg agtttttcat tgtcgctatt gatttttact tcaatgggct
4261  cttccaacaa ggaagaagct tgctggtagc acttgctacc ctgagttcat ccaggcccaa
4321  ctgtgagcaa ggagcacaag ccacaagtct tccagaggat gcttgattcc agtggttctg
4381  cttcaaggct tccactgcaa aacactaaag atccaagaag gccttcatgg ccccagcagg
4441  ccggatcggt actgtatcaa gtcatggcag gtacagtagg ataagccact ctgtcccttc
4501  ctgggcaaag aagaaacgga ggggatggaa ttcttcctta gacttacttt tgtaaaaatg
4561  tccccacggt acttactccc cactgatgga ccagtggttt ccagtcatga gcgttagact
4621  gacttgtttg tcttccattc cattgttttg aaactcagta tgctgcccct gtcttgctgt
4681  catgaaatca gcaagagagg atgcacatc aaataataac tcggattcca gcccacattg
4741  gattcatcag catttggacc aatagcccac agctgagaat gtggaatacc taaggatagc
4801  accgcttttg ttctcgcaaa acgtatctc ctaatttgag gctcagatga aatgcatcag
4861  gtcctttggg gcatagatca gaagactaca aaaatgaagc tgctctgaaa tctcctttag
4921  ccatcacccc aaccccccaa aattagtttg tgttacttat ggaagatagt tttctccttt
4981  tacttcactt caaaagcttt ttactcaaag agtatatgtt ccctccaggt cagctgcccc
5041  caaaccccct ccttacgctt tgtcacacaa aaagtgtctc tgccttgagt catctattca
5101  agcacttaca gctctggcca caacagggca ttttacaggt gcgaatgaca gtagcattat
5161  gagtagtgtg gaattcaggt agtaaatatg aaactagggt ttgaaattga taatgctttc
5221  acaacatttg cagatgtttt agaaggaaaa aagttccttc ctaaaataat ttctctacaa
```

TABLE 1-continued

```
5281  ttggaagatt ggaagattca gctagttagg agcccacctt ttttcctaat ctgtgtgtgc
5341  cctgtaacct gactggttaa cagcagtcct ttgtaaacag tgttttaaac tctcctagtc
5401  aatatccacc ccatccaatt tatcaaggaa gaaatggttc agaaaatatt ttcagcctac
5461  agttatgttc agtcacacac acatacaaaa tgttcctttt gcttttaaag taattttga
5521  ctcccagatc agtcagagcc ctacagcat tgttaagaaa gtatttgatt tttgtctcaa
5581  tgaaaataaa actatattca tttccactct attatgctct caaataccc taagcatcta
5641  tactagcctg gtatgggtat gaaagataca aagataaata aacatagtc cctgattcta
5701  agaaattcac aatttagcaa aggaaatgga ctcatagatg ctaaccttaa acaacgtga
5761  caaatgccag acaggaccca tcagccaggc actgtgagag cacagagcag ggaggttggg
5821  tcctgcctga ggagacctgg aaggggaggcc tcacaggagg atgaccaggt ctcagtcagc
5881  ggggaggtgg aaagtgcagg tgcatcaggg gcaccctgac cgaggaaaca gctgccagag
5941  gcctccactg ctaaagtcca cataaggctg aggtcagtca ccctaaacaa cctgctccct
6001  ctaagccagg ggatgagctt ggagcatccc acaagttccc taaaagttgc agcccccagg
6061  gggattttga gctatcatct ctgcacatgc ttagtgagaa gactacacaa catttctaag
6121  aatctgagat tttatattgt cagttaacca ctttcattat tcattcacct caggacatgc
6181  agaaatattt cagtcagaac tgggaaacag aaggacctac attctgctgt cacttatgtg
6241  tcaagaagca gatgatcgat gaggcaggtc agttgtaagt gagtcacatt gtagcattaa
6301  attctagtat ttttgtagtt tgaaacagta acttaataaa agagcaaaag ctaaaaaaaa
6361  aaaaaaaa
```

SEQ ID NO: 92 Human EGFR Amino Acid Sequence Isoform A (NP_005219.2)

```
   1  mrpsgtagaa llallaalcp asraleekkv cqgtsnkltq lgtfedhfls lqrmfnncev
  61  vlgnleityv qrnydlsflk tigevagyvl ialntverip lenlqiirgn myyensyala
 121  vlsnydankt glkelpmrnl qeilhgavrf snnpalcnve siqwrdivss dflsnmsmdf
 181  qnhlgscqkc dpscpngscw gageencqkl tkiicaqqcs grcrgkspsd cchnqcaagc
 241  tgpresdclv crkfrdeatc kdtcpplmly npttyqmdvn pegkysfgat cvkkcprnyv
 301  vtdhgscvra cgadsyemee dgvrkckkce gpcrkvcngi gigefkdsls inatnikhfk
 361  nctsisgdlh ilpvafrgds fthtppldpq eldilktvke itgflliqaw penrtdlhaf
 421  enleiirgrt kqhgqfslav vslnitslgl rslkeisdgd viisgnknlc yantinwkkl
 481  fgtsgqktki isnrgensck atgqvchalc spegcwgpep rdcvscrnvs rgrecvdkcn
 541  llegeprefv enseciqchp eclpqamnit ctgrgpdnci qcahyidgph cvktcpagvm
 601  genntivwky adaghvchlc hpnctygctg pglegcptng pkipsiatgm vgalllllvv
 661  algiglfmrr rhivrkrtlr rllgerelve pltpsgeapn qallrilket efkkikvlgs
 721  gafgtvykgl wipegekvki pvaikelrea tspkankeil deayvmasvd nphvcrllgi
 781  cltstvglit qlmpfgclld yvrehkdnig sqyllnwcvq iakgmnyled rrlvhrdlaa
 841  rnvlvktpqh vkitdfglak llgaeekeyh aeggkvpikw malesilhri ythqsdvwsy
 901  gvtvwelmtf gskpydgipa seissilekg erlpqppict idvymimvkc wmidadsrpk
 961  freliiefsk mardpqrylv iqgdermhlp sptdsnfyra lmdeedmddv vdadeylipq
1021  qgffsspsts rtpllsslsa tsnnstvaci drnglqscpi kedsflqrys sdptgalted
1081  siddtflpvp eyinqsvpkr pagsvqnpvy hnqplnpaps rdphyqdphs tavgnpeyln
1141  tvgptcvnst fdspahwaqk gshqisldnp dyqqdffpke akpngifkgs taenaeylry
1201  apqssefiga
```

TABLE 1-continued

SEQ ID NO: 93 Human EGFR cDNA Sequence Variant 2 (NM_201282.1, CDS: from 247 to 2133)

```
   1  ccccggcgca gcgcggccgc agcagcctcc gcccccgca cggtgtgagc gcccgacgcg
  61  gccgaggcgg ccggagtccc gagctagccc cggcggccgc cgccgcccag accggacgac
 121  aggccacctc gtcggcgtcc gcccgagtcc ccgcctcgcc gccaacgcca caaccaccgc
 181  gcacggcccc ctgactccgt ccagtattga tcgggagagc cggagcgagc tcttcgggga
 241  gcagcgatgc gaccctccgg gacggcgggg cagcgctcc tggcgctgct ggctgcgctc
 301  tgcccggcga gtcgggctct ggaggaaaag aaagtttgcc aaggcacgag taacaagctc
 361  acgcagttgg gcacttttga agatcatttt ctcagcctcc agaggatgtt caataactgt
 421  gaggtggtcc ttgggaattt ggaaattacc tatgtgcaga ggaattatga tctttccttc
 481  ttaaagacca tccaggaggt ggctggttat gtcctcattg ccctcaacac agtggagcga
 541  attcctttgg aaaacctgca gatcatcaga ggaaatatgt actacgaaaa ttcctatgcc
 601  ttagcagtct tatctaacta tgatgcaaat aaaaccggac tgaaggagct gcccatgaga
 661  aatttacagg aaatcctgca tggcgccgtg cggttcagca caaccctgc cctgtgcaac
 721  gtggagagca tccagtggcg ggacatagtc agcagtgact ttctcagcaa catgtcgatg
 781  gacttccaga accacctggg cagctgccaa aagtgtgatc caagctgtcc aatgggagc
 841  tgctggggtg caggagagga gaactgccag aaactgacca aaatcatctg tgcccagcag
 901  tgctccgggc gctgccgtgg caagtccccc agtgactgct gccacaacca gtgtgctgca
 961  ggctgcacag gcccccggga gagcgactgc ctggtctgcc gcaaattccg agacgaagcc
1021  acgtgcaagg acacctgccc cccactcatg ctctacaacc ccaccacgta ccagatggat
1081  gtgaaccccg agggcaaata cagctttggt gccacctgcg tgaagaagtg tccccgtaat
1141  tatgtggtga cagatcacgg ctcgtgcgtc cgagcctgtg ggccgacag ctatgagatg
1201  gaggaagacg gcgtccgcaa gtgtaagaag tgcgaagggc cttgccgcaa agtgtgtaac
1261  ggaataggta ttggtgaatt taaagactca ctctccataa atgctacgaa tattaaacac
1321  ttcaaaaact gcacctccat cagtggcgat ctccacatcc tgccggtggc atttaggggt
1381  gactccttca cacatactcc tcctctggat ccacaggaac tggatattct gaaaaccgta
1441  aaggaaatca cagggttttt gctgattcag gcttggcctg aaaacaggac ggacctccat
1501  gcctttgaga acctagaaat catacgcggc aggaccaagc aacatggtca gttttctctt
1561  gcagtcgtca gcctgaacat aacatccttg ggattacgct ccctcaagga gataagtgat
1621  ggagatgtga taatttcagg aaacaaaaat ttgtgctatg caaatacaat aaactggaaa
1681  aaactgtttg gacctccgg tcagaaaacc aaaattataa gcaacagagg tgaaaacagc
1741  tgcaaggcca caggccaggt ctgccatgcc ttgtgctccc ccgagggctg ctggggcccg
1801  gagcccaggg actgcgtctc ttgccggaat gtcagccgag cagggaatcg cgtggacaag
1861  tgcaaccttc tggagggtga gccaagggag tttgtggaga actctgagtc atacagtgc
1921  cacccagagt gcctgcctca ggccatgaac atcacctgca ggacggggg accagacaac
1981  tgtatccagt gtgcccacta cattgacggc ccccactgcg tcaagacctg cccggcagga
2041  gtcatgggag aaaacaacac cctggtctgg aagtacgcag acgccggcca tgtgtgccac
2101  ctgtgccatc caaactgcac ctacggtcc taataaatct tcactgtctg actttagtct
2161  cccactaaaa ctgcatttcc tttctacaat ttcaatttct ccctttgctt caaataaagt
2221  cctgacacta ttcatttga
```

TABLE 1-continued

SEQ ID NO: 94 Human EGFR Amino Acid Sequence Isoform B (NP_9584391)
```
   1  mrpsgtagaa llallaalcp asraleekkv cqgtsnkltq lgtfedhfls lqrmfnncev
  61  vlgnleityv qrnydlsflk tigevagyvl ialntverip lenlqiirgn myyensyala
 121  vlsnydankt glkelpmrnl qeilhgavrf snnpalcnve siqwrdivss dflsnmsmdf
 181  qnhlgscqkc dpscpngscw gageencqkl tkiicaqqcs grcrgkspsd cchnqcaagc
 241  tgpresdclv crkfrdeatc kdtcpplmly npttyqmdvn pegkysfgat cvkkcprnyv
 301  vtdhgscvra cgadsyemee dgvrkckkce gpcrkvcngi gigefkdsls inatnikhfk
 361  nctsisgdlh ilpvafrgds fthtppldpq eldilktvke itgflliqaw penrtdlhaf
 421  enleiirgrt kqhgqfslav vslnitslgl rslkeisdgd viisgnknlc yantinwkkl
 481  fgtsgqktki isnrgensck atgqvchalc spegcwgpep rdcvscrnvs rgrecvdkcn
 541  llegeprefv enseciqchp eclpqamnit ctgrgpdnci qcahyidgph cvktcpagvm
 601  genntivwky adaghvchlc hpnctygs
```

SEQ ID NO: 95 Human EGFR cDNA Sequence Variant 3 (NM_201283.1, CDS: from 247 to 1464)
```
   1  ccccggcgca gcgcggccgc agcagcctcc gcccccgca cggtgtgagc gcccgacgcg
  61  gccgaggcgg ccggagtccc gagctagccc cggcggccgc cgccgcccag accggacgac
 121  aggccacctc gtcggcgtcc gcccgagtcc ccgcctcgcc gccaacgcca caaccaccgc
 181  gcacggcccc ctgactccgt ccagtattga tcgggagagc cggagcgagc tcttcgggga
 241  gcagcgatgc gaccctccgg gacggccggg cagcgctcc tggcgctgct ggctgcgctc
 301  tgcccggcga gtcgggctct ggaggaaaag aaagtttgcc aaggcacgag taacaagctc
 361  acgcagttgg gcactttga agatcatttt ctcagcctcc agaggatgtt caataactgt
 421  gaggtggtcc ttgggaattt ggaaattacc tatgtgcaga ggaattatga tctttccttc
 481  ttaaagacca tccaggaggt ggctggttat gtcctcattg ccctcaacac agtggagcga
 541  attcctttgg aaaacctgca gatcatcaga ggaaatatgt actacgaaaa ttcctatgcc
 601  ttagcagtct tatctaacta tgatgcaaat aaaaccggac tgaaggagct gcccatgaga
 661  aatttacagg aaatcctgca tggcgccgtg cggttcagca acaaccctgc cctgtgcaac
 721  gtggagagca tccagtggcg ggacatagtc agcagtgact ttctcagcaa catgtcgatg
 781  gacttccaga accacctggg cagctgccaa agtgtgatc caagctgtcc aatgggagc
 841  tgctggggtg caggagagga gaactgccag aaactgacca aaatcatctg tgcccagcag
 901  tgctccgggc gctgccgtgg caagtccccc agtgactgct gccacaacca gtgtgctgca
 961  ggctgcacag gccccgggga gagcgactgc ctggtctgcc gcaaattccg agacgaagcc
1021  acgtgcaagg acacctgccc cccactcatg ctctacaacc ccaccacgta ccagatggat
1081  gtgaaccccg agggcaaata cagctttggt gccacctgcg tgaagaagtg tccccgtaat
1141  tatgtggtga cagatcacgg ctcgtgcgtc cgagcctgtg gggccgacag ctatgagatg
1201  gaggaagacg gcgtccgcaa gtgtaagaag tgcgaagggc cttgccgcaa agtgtgtaac
1261  ggaataggta ttggtgaatt taaagactca ctctccataa atgctacgaa tattaaacac
1321  ttcaaaaact gcacctccat cagtggcgat ctccacatcc tgccggtggc atttaggggt
1381  gactccttca cacatactcc tcctctggat ccacaggaac tggatattct gaaaaccgta
1441  aaggaaatca caggttttgag ctgaattatc acatgaatat aaatgggaaa tcagtgtttt
1501  agagagagaa cttttcgaca tatttcctgt tcccttggaa taaaaacatt tcttctgaaa
1561  ttttaccgtt aaaaaaaaaa aaaaaaaaaa aaaaa
```

TABLE 1-continued

SEQ ID NO: 96 Human EGFR Amino Acid Sequence Isoform C (NP_958440.1)

```
  1 mrpsgtagaa llallaalcp asraleekkv cqgtsnkltq lgtfedhfls lqrmfnncev
 61 vlgnleityv qrnydlsflk tigevagyvl ialntverip lenlqiirgn myyensyala
121 vlsnydankt glkelpmrnl qeilhgavrf snnpalcnve siqwrdivss dflsnmsmdf
181 qnhlgscqkc dpscpngscw gageencqkl tkiicaqqcs grcrgkspsd cchnqcaagc
241 tgpresdclv crkfrdeatc kdtcpplmly npttyqmdvn pegkysfgat cvkkcprnyv
301 vtdhgscvra cgadsyemee dgvrkckkce gpcrkvcngi gigefkdsls inatnikhfk
361 nctsisgdlh ilpvafrgds fthtppldpq eldilktvke itgls
```

SEQ ID NO: 97 Human EGFR cDNA Sequence Variant 4 (NM_201284.1, CDS: from 247 to 2364)

```
   1 ccccggcgca gcgcggccgc agcagcctcc gcccccgca cggtgtgagc gcccgacgcg
  61 gccgaggcgg ccggagtccc gagctagccc cggcggccgc cgccgcccag accggacgac
 121 aggccacctc gtcggcgtcc gcccgagtcc ccgcctcgcc gccaacgcca caaccaccgc
 181 gcacggcccc ctgactccgt ccagtattga tcgggagagc cggagcgagc tcttcgggga
 241 gcagcgatgc gaccctccgg gacggccggg gcagcgctcc tggcgctgct ggctgcgctc
 301 tgcccggcga gtcgggctct ggaggaaaag aaagtttgcc aaggcacgag taacaagctc
 361 acgcagttgg gcactttga agatcatttt ctcagcctcc agaggatgtt caataactgt
 421 gaggtggtcc ttgggaattt ggaaattacc tatgtgcaga ggaattatga tctttccttc
 481 ttaaagacca ccaggaggt ggctggttat gtcctcattg ccctcaacac agtggagcga
 541 attcctttgg aaaacctgca gatcatcaga ggaaatatgt actacgaaaa ttcctatgcc
 601 ttagcagtct tatctaacta tgatgcaaat aaaaccggac tgaaggagct gcccatgaga
 661 aatttacagg aaatcctgca tggcgccgtg cggttcagca acaaccctgc cctgtgcaac
 721 gtggagagca tccagtggcg ggacatagtc agcagtgact tctctcagca catgtcgatg
 781 gacttccaga accacctggg cagctgccaa aagtgtgatc caagctgtcc caatgggagc
 841 tgctggggtg caggagagga gaactgccag aaactgacca aaatcatctg tgcccagcag
 901 tgctccggc gctgccgtgg caagtccccc agtgactgct gccacaacca gtgtgctgca
 961 ggctgcacag gcccccggga gagcgactgc ctggtctgcc gcaaattccg agacgaagcc
1021 acgtgcaagg acacctgccc cccactcatg ctctacaacc ccaccacgta ccagatggat
1081 gtgaaccccg agggcaaata cagctttggt gccacctgcg tgaagaagtg tccccgtaat
1141 tatgtggtga cagatcacgg ctcgtgcgtc cgagcctgtg ggccgacag ctatgagatg
1201 gaggaagacg gcgtccgcaa gtgtaagaag tgcgaagggc cttgccgcaa agtgtgtaac
1261 ggaataggta ttggtgaatt taaagactca ctctccataa atgctacgaa tattaaacac
1321 ttcaaaaact gcacctccat cagtggcgat ctccacatcc tgccggtggc atttaggggt
1381 gactccttca cacatactcc tcctctggat ccacaggaac tggatattct gaaaaccgta
1441 aaggaaatca cagggttttt gctgattcag gcttggcctg aaaacaggac ggacctccat
1501 gcctttgaga acctagaaat catacgcggc aggaccaagc aacatggtca gttttctctt
1561 gcagtcgtca gcctgaacat aacatccttg ggattacgct ccctcaagga taagtgat
1621 ggagatgtga taatttcagg aaacaaaaat tgtgctatg caaatacaat aaactggaaa
1681 aaactgtttg gacctccgg tcagaaaacc aaaattataa gcaacagagg tgaaaacagc
1741 tgcaaggcca caggccaggt ctgccatgcc ttgtgctccc ccgagggctg ctggggcccg
1801 gagcccaggg actgcgtctc ttgccggaat gtcagccgag caggaatgcg tggacaag
1861 tgcaaccttc tggagggtga gccaagggag tttgtggaga actctgagtg catacagtgc
```

TABLE 1-continued

```
1921  cacccagagt gcctgcctca ggccatgaac atcacctgca caggacgggg accagacaac 1981  tgtatccagt gtgcccacta cattgacggc ccccactgcg tcaagacctg cccggcagga 2041  gtcatgggag aaaacaacac cctggtctgg aagtacgcag acgccggcca tgtgtgccac 2101  ctgtgccatc caaactgcac ctacgggcca ggaaatgaga gtctcaaagc catgttattc 2161  tgcctttta aactatcatc ctgtaatcaa agtaatgatg gcagcgtgtc ccaccagagc 2221  gggagcccag ctgctcagga gtcatgctta ggatggatcc cttctcttct gccgtcagag 2281  tttcagctgg gttggggtgg atgcagccac ctccatgcct ggccttctgc atctgtgatc 2341  atcacggcct cctcctgcca ctgagcctca tgccttcacg tgtctgttcc cccgctttt 2401  cctttctgcc acccctgcac gtgggccgcc aggttcccaa gagtatccta cccatttcct 2461  tccttccact cccttgcca gtgcctctca ccccaactag tagctaacca tcaccccag 2521  gactgacctc ttcctcctcg ctgccagatg attgttcaaa gcacagaatt tgtcagaaac 2581  ctgcagggac tccatgctgc cagccttctc cgtaattagc atggccccag tccatgcttc 2641  tagccttggt tccttctgcc cctctgtttg aaattctaga gccagctgtg gacaattat 2701  ctgtgtcaaa agccagatgt gaaaacatct caataacaaa ctggctgctt tgttcaatgc 2761  tagaacaacg cctgtcacag agtagaaact caaaatatt tgctgagtga atgaacaaat 2821  gaataaatgc ataataaata attaaccacc aatccaacat ccaga
```

SEQ ID NO: 98 Human EGFR Amino Acid Sequence Isoform D (NP_958441.1)
```
  1  mrpsgtagaa llallaalcp asraleekkv cqgtsnkltq lgtfedhfls lqrmfnncev 61  vlgnleityv qrnydlsflk tigevagyvl ialntverip lenlqiirgn myyensyala 121  vlsnydankt glkelpmrnl qeilhgavrf snnpalcnve siqwrdivss dflsnmsmdf 181  qnhlgscqkc dpscpngscw gageencqkl tkiicaqqcs grcrgkspsd cchnqcaagc 241  tgpresdclv crkfrdeatc kdtcpplmly npttyqmdvn pegkysfgat cvkkcprnyv 301  vtdhgscvra cgadsyemee dgvrkckkce gpcrkvcngi gigefkdsls inatnikhfk 361  nctsisgdlh ilpvafrgds fthtppldpq eldilktvke itgflliqaw penrtdlhaf 421  enleiirgrt kqhgqfslav vslnitslgl rslkeisdgd viisgnknlc yantinwkkl 481  fgtsgqktki isnrgensck atgqvchalc spegcwgpep rdcvscrnvs rgrecvdkcn 541  llegeprefv enseciqchp eclpqamnit ctgrgpdnci qcahyidgph cvktcpagvm 601  genntivwky adaghvchlc hpnctygpgn eslkamlfcl fklsscnqsn dgsyshqsgs 661  paagesclgw ipsllpsefq lgwggcshlh awpsasviit assch
```

SEQ ID NO: 99 Human EGFR cDNA Sequence Variant 5 (NM_001346897.1, CDS: from 1258 to 3533)
```
  1  gtccgggcag ccccggcgc agcgcggccg cagcagcctc cgccccccgc acggtgtgag 61  cgcccgacgc ggccgaggcg gccggagtcc cgagctagcc ccggcggccg ccgccgccca 121  gaccggacga caggccacct cgtcggcgtc cgcccgagtc cccgcctcgc cgccaacgcc 181  acaaccaccg cgcacggccc cctgactccg tccagtattg atcggagag ccggagcgag 241  ctcttcgggg agcagcgatg cgaccctccg gacggccgg ggcagcgctc ctggcgctgc 301  tggctgcgct ctgcccggcg agtcgggctc tggaggaaaa gaaagtttgc caaggcacga 361  gtaacaagct cacgcagttg ggcacttttg aagatcattt tctcagcctc cagaggatgt 421  tcaataactg tgaggtggtc cttgggaatt tggaaattac ctatgtgcag aggaattatg 481  atctttcctt cttaaagacc atccaggagg tggctggtta tgtcctcatt gccctcaaca 541  cagtggagcg aattcctttg gaaaaccctgc agatcatcag aggaaatatg tactacgaaa 601  attcctatgc cttagcagtc ttatctaact atgatgcaaa taaaaccgga ctgaaggagc
```

TABLE 1-continued

```
 661 tgcccatgag aaatttacag ggccaaaagt gtgatccaag ctgtcccaat gggagctgct
 721 ggggtgcagg agaggagaac tgccagaaac tgaccaaaat catctgtgcc cagcagtgct
 781 ccgggcgctg ccgtggcaag tcccccagtg actgctgcca caaccagtgt gctgcaggct
 841 gcacaggccc ccgggagagc gactgcctgg tctgccgcaa attccgagac gaagccacgt
 901 gcaaggacac ctgcccccca ctcatgctct acaaccccac cacgtaccag atggatgtga
 961 accccgaggg caaatacagc tttggtgcca cctgcgtgaa gaagtgtccc cgtaattatg
1021 tggtgacaga tcacggctcg tgcgtccgag cctgtggggc cgacagctat gagatggagg
1081 aagacggcgt ccgcaagtgt aagaagtgcg aagggccttg ccgcaaagtg tgtaacggaa
1141 taggtattgg tgaatttaaa gactcactct ccataaatgc tacgaatatt aaacacttca
1201 aaaactgcac ctccatcagt ggcgatctcc acatcctgcc ggtggcattt aggggtgact
1261 ccttcacaca tactcctcct ctggatccac aggaactgga tattctgaaa accgtaaagg
1321 aaatcacagg ttttttgctg attcaggctt ggcctgaaaa caggacggac ctccatgcct
1381 ttgagaacct agaaatcata cgcggcagga ccaagcaaca tggtcagttt tctcttgcag
1441 tcgtcagcct gaacataaca tccttgggat tacgctccct caaggagata agtgatggag
1501 atgtgataat tcaggaaac aaaaatttgt gctatgcaaa tacaataaac tggaaaaaac
1561 tgtttgggac ctccggtcag aaaaccaaaa ttataagcaa cagaggtgaa aacagctgca
1621 aggccacagg ccaggtctgc catgccttgt gctcccccga gggctgctgg ggcccggagc
1681 ccagggactg cgtctcttgc cggaatgtca gccgaggcag ggaatgcgtg gacaagtgca
1741 accttctgga gggtgagcca agggagtttg tggagaactc tgagtgcata cagtgccacc
1801 cagagtgcct gcctcaggcc atgaacatca cctgcacagg acggggacca gacaactgta
1861 tccagtgtgc ccactacatt gacggccccc actgcgtcaa gacctgcccg gcaggagtca
1921 tgggagaaaa caacaccctg gtctggaagt acgcagacgc cggccatgtg tgccacctgt
1981 gccatccaaa ctgcacctac ggatgcactg ggccaggtct tgaaggctgt ccaacgaatg
2041 ggcctaagat cccgtccatc gccactggga tggtgggggc cctcctcttg ctgctggtgg
2101 tggccctggg gatcggcctc ttcatgcgaa ggcgccacat cgttcggaag cgcacgctgc
2161 ggaggctgct gcaggagagg gagcttgtgg agcctcttac acccagtgga gaagctccca
2221 accaagctct cttgaggatc ttgaaggaaa ctgaattcaa aaagatcaaa gtgctgggct
2281 ccggtgcgtt cggcacggtg tataagggac tctggatccc agaaggtgag aaagttaaaa
2341 ttcccgtcgc tatcaaggaa ttaagagaag caacatctcc gaaagccaac aaggaaatcc
2401 tcgatgaagc ctacgtgatg gccagcgtgg acaaccccca cgtgtgccgc ctgctgggca
2461 tctgcctcac ctccaccgtg cagctcatca cgcagctcat gcccttcggc tgcctcctgg
2521 actatgtccg ggaacacaaa gacaatattg ctcccagta cctgctcaac tggtgtgtgc
2581 agatcgcaaa gggcatgaac tacttggagg accgtcgctt ggtgcaccgc gacctggcag
2641 ccaggaacgt actggtgaaa acaccgcagc atgtcaagat cacagatttt gggctggcca
2701 aactgctggg tgcggaagag aaagaatacc atgcagaagg aggcaaagtg cctatcaagt
2761 ggatggcatt ggaatcaatt ttacacagaa tctatacccca ccagagtgat gtctggagct
2821 acggggtgac tgtttgggag ttgatgacct ttggatccaa gccatatgac ggaatccctg
2881 ccagcgagat ctcctccatc ctggagaaag gagaacgcct ccctcagcca cccatatgta
2941 ccatcgatgt ctacatgatc atggtcaagt gctggatgat agacgcagat agtcgcccaa
3001 agttccgtga gttgatcatc gaattctcca aaatggcccg agacccccag cgctaccttg
```

TABLE 1-continued

```
3061 tcattcaggg ggatgaaaga atgcatttgc caagtcctac agactccaac ttctaccgtg
3121 ccctgatgga tgaagaagac atggacgacg tggtggatgc cgacgagtac ctcatcccac
3181 agcagggctt cttcagcagc cctccacgt cacggactcc cctcctgagc tctctgagtg
3241 caaccagcaa caattccacc gtggcttgca ttgatagaaa tgggctgcaa agctgtccca
3301 tcaaggaaga cagcttcttg cagcgataca gctcagaccc cacaggcgcc ttgactgagg
3361 acagcataga cgacaccttc ctcccagtgc ctggtgagtg gcttgtctgg aaacagtcct
3421 gctcctcaac ctcctcgacc cactcagcag cagccagtct ccagtgtcca gccaggtgc
3481 tccctccagc atctccagag ggggaaacag tggcagattt gcagacacag tgaagggcgt
3541 aaggagcaga taaacacatg accgagcctg cacaagctct tgttgtgtc tggttgtttg
3601 ctgtacctct gttgtaagaa tgaatctgca aaatttctag cttatgaagc aaatcacgga
3661 catacacatc tgtgtgtgtg agtgttcatg atgtgtgtac atctgtgtat gtgtgtgtgt
3721 gtatgtgtgt gtttgtgaca gatttgatcc ctgttctctc tgctggctct atcttgacct
3781 gtgaaacgta tatttaacta attaaatatt agttaatatt aataaatttt aagctttatc
3841 cagaaaaaaa aaaaaaaaa
```

SEQ ID NO: 100 Human EGFR Amino Acid Sequence Isoform E (NP_001333826.1)
```
   1 mrpsgtagaa llallaalcp asraleekkv cqgtsnkltq lgtfedhfls lqrmfnncev
  61 vlgnleityv qrnydlsflk tigevagyvl ialntverip lenlqiirgn myyensyala
 121 vlsnydankt glkelpmrnl qgqkcdpscp ngscwgagee ncqkltkiic aqqcsgrcrg
 181 kspsdcchnq caagctgpre sdclvcrkfr deatckdtcp plmlynptty qmdvnpegky
 241 sfgatcvkkc prnyvvtdhg scvracgads yemeedgvrk ckkcegperk vcngigigef
 301 kdslsinatn ikhfknctsi sgdlhilpva frgdsfthtp pldpqeldil ktvkeitgfl
 361 liqawpenrt dlhafenlei irgrtkqhgq fslavvslni tslglrslke isdgdviisg
 421 nknlcyanti nwkklfgtsg qktkiisnrg ensckatgqv chalcspegc wgpeprdcvs
 481 crnvsrgrec vdkcnllege prefvensec iqchpeclpq amnitctgrg pdnciqcahy
 541 idgphcvktc pagvmgennt lvwkyadagh vchlchpnct ygctgpgleg cptngpkips
 601 iatgmvgall lllvvalgig lfmrrrhivr krtlrrllqe relveplptps geapnqallr
 661 ilketefkki kvlgsgafgt vykglwipeg ekvkipvaik elreatspka nkeildeayv
 721 masvdnphvc rllgicltst vglitqlmpf gclldyvreh kdnigsqyll nwcvgiakgm
 781 nyledrrlvh rdlaarnvlv ktpqhvkitd fglakllgae ekeyhaeggk vpikwmales
 841 ilhriythqs dvwsygvtvw elmtfgskpy dgipaseiss ilekgerlpq ppictidvym
 901 imvkcwmida dsrpkfreli iefskmardp grylviggde rmhlpsptds nfyralmdee
 961 dmddvvdade ylipqqgffs spstsrtpll sslsatsnns tvacidrngl qscpikedsf
1021 lqryssdptg altedsiddt flpvpgewlv wkqscsstss thsaaaslqc psqvlppasp
1081 egetvadlqt q
```

SEQ ID NO: 101 Human EGFR cDNA Sequence Variant 6 (NM_001346898.1, CDS: from 258 to 3668)
```
   1 gtccgggcag cccccggcgc agcgcggccg cagcagcctc cgccccccgc acggtgtgag
  61 cgcccgacgc ggccgaggcg gccggagtcc cgagctagcc ccggcggccg ccgccgccca
 121 gaccggacga caggccacct cgtcggcgtc cgcccgagtc ccgcctcgc cgccaacgcc
 181 acaaccaccg cgcacggccc cctgactccg tccagtattg atcgggagag ccggagcgag
 241 ctcttcgggg agcagcgatg cgaccctccg gacgccggg gcagcgctc ctggcgctgc
 301 tggctgcgct ctgcccggcg agtcgggctc tggaggaaaa gaaagtttgc caaggcacga
```

TABLE 1-continued

```
 361 gtaacaagct cacgcagttg ggcacttttg aagatcattt tctcagcctc cagaggatgt
 421 tcaataactg tgaggtggtc cttgggaatt tggaaattac ctatgtgcag aggaattatg
 481 atctttcctt cttaaagacc atccaggagg tggctggtta tgtcctcatt gccctcaaca
 541 cagtggagcg aattcctttg gaaaacctgc agatcatcag aggaaatatg tactacgaaa
 601 attcctatgc cttagcagtc ttatctaact atgatgcaaa taaaaccgga ctgaaggagc
 661 tgcccatgag aaatttacag gaaatcctgc atgcgccgt gcggttcagc aacaaccctg
 721 ccctgtgcaa cgtggagagc atccagtggc gggacatagt cagcagtgac tttctcagca
 781 acatgtcgat ggacttccag aaccacctgg gcagctgcca aaagtgtgat ccaagctgtc
 841 ccaatgggag ctgctggggt gcaggagagg agaactgcca gaaactgacc aaaatcatct
 901 gtgcccagca gtgctccggg cgctgccgtg gcaagtcccc cagtgactgc tgccacaacc
 961 agtgtgctgc aggctgcaca ggccccgggg agagcgactg cctggtctgc cgcaaattcc
1021 gagacgaagc cacgtgcaag gacacctgcc cccactcat gctctacaac cccaccacgt
1081 accagatgga tgtgaacccc gagggcaaat acagctttgg tgccacctgc gtgaagaagt
1141 gtccccgtaa ttatgtggtg acagatcacg gctcgtgcgt ccgagcctgt ggggccgaca
1201 gctatgagat ggaggaagac ggcgtccgca agtgtaagaa gtgcgaaggg ccttgccgca
1261 aagtgtgtaa cggaataggt attggtgaat ttaaagactc actctccata aatgctacga
1321 atattaaaca cttcaaaaac tgcacctcca tcagtggcga tctccacatc ctgccggtgg
1381 catttagggg tgactccttc acacatactc ctcctctgga tccacaggaa ctggatattc
1441 tgaaaaccgt aaaggaaatc acagggtttt tgctgattca ggcttggcct gaaaacagga
1501 cggacctcca tgcctttgag aacctagaaa tcatacgcgg caggaccaag caacatggtc
1561 agttttctct tgcagtcgtc agcctgaaca taacatcctt gggattacgc tccctcaagg
1621 agataagtga tggagatgtg ataatttcag gaaacaaaaa tttgtgctat gcaaatacaa
1681 taaactggaa aaaactgttt gggacctccg gtcagaaaac caaaattata agcaacagag
1741 gtgaaaacag ctgcaaggcc acaggccagg tctgccatgc cttgtgctcc cccgagggct
1801 gctgggcc ggagcccagg gactgcgtct cttgccggaa tgtcagccga ggcagggaat
1861 gcgtggacaa gtgcaacctt ctggagggtg agccaaggga gtttgtggag aactctgagt
1921 gcatacagtg ccacccagag tgcctgcctc aggccatgaa catcacctgc acaggacggg
1981 gaccagacaa ctgtatccag tgtgcccact acattgacgg ccccactgc gtcaagacct
2041 gcccggcagg agtcatggga gaaaacaaca ccctggtctg gaagtacgca gacgccggcc
2101 atgtgtgcca cctgtgccat ccaaactgca cctacggatg cactgggcca ggtcttgaag
2161 gctgtccaac gaatgggcct aagatcccgt ccatcgccac tgggatggtg ggggccctcc
2221 tcttgctgct ggtggtggcc ctggggatcg gcctcttcat gcgaaggcgc cacatcgttc
2281 ggaagcgcac gctgcggagg ctgctgcagg agagggagct tgtggagcct cttacaccca
2341 gtggagaagc tcccaaccaa gctctcttga ggatcttgaa ggaaactgaa ttcaaaaaga
2401 tcaaagtgct gggctccggt gcgttcggca cggtgtataa gggactctgg atcccagaag
2461 gtgagaaagt taaaattccc gtcgctatca aggaattaag agaagcaaca ctctccgaaag
2521 ccaacaagga aatcctcgat gaagcctacg tgatggccag cgtggacaac ccccacgtgt
2581 gccgcctgct gggcatctgc ctcacctcca ccgtgcagct catcacgcag ctcatgccct
2641 tcggctgcct cctggactat gtccgggaac acaaagacaa tattggctcc cagtacctgc
2701 tcaactggtg tgtgcagatc gcaaagggca tgaactactt ggaggaccgt cgcttggtgc
```

TABLE 1-continued

```
2761  accgcgacct ggcagccagg aacgtactgg tgaaaacacc gcagcatgtc aagatcacag
2821  attttgggct ggccaaactg ctgggtgcgg aagagaaaga ataccatgca gaaggaggca
2881  aagtgcctat caagtggatg gcattggaat caattttaca cagaatctat acccaccaga
2941  gtgatgtctg gagctacggg gtgactgttt gggagttgat gacctttgga tccaagccat
3001  atgacggaat ccctgccagc gagatctcct ccatcctgga aaaggagaa cgcctccctc
3061  agccacccat atgtaccatc gatgtctaca tgatcatggt caagtgctgg atgatagacg
3121  cagatagtcg cccaaagttc cgtgagttga tcatcgaatt ctccaaaatg ccccgagacc
3181  cccagcgcta ccttgtcatt caggggggatg aaagaatgca tttgccaagt cctacagact
3241  ccaacttcta ccgtgccctg atggatgaag aagacatgga cgacgtggtg gatgccgacg
3301  agtacctcat cccacagcag ggcttcttca gcagcccctc cacgtcacgg actcccctcc
3361  tgagctctct gagtgcaacc agcaacaatt ccaccgtggc ttgcattgat agaaatgggc
3421  tgcaaagctg tcccatcaag gaagacagct tcttgcagcg atacagctca gaccccacag
3481  gcgccttgac tgaggacagc atagacgaca ccttcctccc agtgcctggt gagtggcttg
3541  tctggaaaca gtcctgctcc tcaacctcct cgacccactc agcagcagcc agtctccagt
3601  gtccaagcca ggtgctccct ccagcatctc cagaggggga acagtggca gatttgcaga
3661  cacagtgaag ggcgtaagga gcagataaac acatgaccga gcctgcacaa gctctttgtt
3721  gtgtctggtt gtttgctgta cctctgttgt aagaatgaat ctgcaaaatt tctagcttat
3781  gaagcaaatc acggacatac acatctgtgt gtgtgagtgt tcatgatgtg tgtacatctg
3841  tgtatgtgtg tgtgtgtatg tgtgtgtttg tgacagattt gatccctgtt ctctctgctg
3901  gctctatctt gacctgtgaa acgtatattt aactaattaa atattagtta atattaataa
3961  attttaagct ttatccagaa aaaaaaaaaa aaaa
```

SEQ ID NO: 102 Human EGFR Amino Acid Sequence Isoform F (NP_001333827.1)

```
   1  mrpsgtagaa llallaalcp asraleekkv cqgtsnkltq lgtfedhfls lqrmfnncev
  61  vlgnleityv qrnydlsflk tigevagyvl ialntverip lenlqiirgn myyensyala
 121  vlsnydankt glkelpmrnl qeilhgavrf snnpalcnve siqwrdivss dflsnmsmdf
 181  qnhlgscqkc dpscpngscw gageencqkl tkiicaqqcs grcrgkspsd cchnqcaagc
 241  tgpresdclv crkfrdeatc kdtcpplmly npttyqmdvn pegkysfgat cvkkcprnyv
 301  vtdhgscvra cgadsyemee dgvrckkce gpcrkvcngi gigefkdsls inatnikhfk
 361  nctsisgdlh ilpvafrgds fthtppldpq eldilktvke itgflliqaw penrtdlhaf
 421  enleiirgrt kqhgqfslav vslnitslgl rslkeisdgd viisgnknlc yantinwkkl
 481  fgtsgqktki isnrgensck atgqvchalc spegcwgpep rdcvscrnvs rgrecvdkcn
 541  llegeprefv enseciqchp eclpqamnit ctgrgpdnci qcahyidgph cvktcpagvm
 601  genntivwky adaghvchlc hpnctygctg pglegcptng pkipsiatgm vgalllllvv
 661  algiglfmrr rhivrkrtlr rllgerelve pltpsgeapn qallrilket efkkikvlgs
 721  gafgtvykgl wipegekvki pvaikelrea tspkankeil deayvmasvd nphvcrllgi
 781  cltstvglit qlmpfgclld yvrehkdnig sqyllnwcvq iakgmnyled rrlvhrdlaa
 841  rnvlvktpqh vkitdfglak llgaeekeyh aeggkvpikw malesilhri ythqsdvwsy
 901  gvtvwelmtf gskpydgipa seissilekg erlpqppict idvymimvkc wmidadsrpk
 961  freliiefsk mardpqrylv iqgdermhlp sptdsnfyra lmdeedmddv vdadeylipq
1021  qgffsspsts rtpllsslsa tsnnstvaci drnglqscpi kedsflqrys sdptgalted
1081  siddtflpvp gewlvwkqsc sstssthsaa aslqcpsqvl ppaspegetv adlqtq
```

TABLE 1-continued

SEQ ID NO: 103 Human EGFR cDNA Sequence Variant 7 (NM_001346899.1, CDS: from 258 to 3755)

```
   1  gtccgggcag ccccggcgc agcgcggccg cagcagcctc cgcccccgc acggtgtgag
  61  cgcccgacgc ggccgaggcg gccggagtcc cgagctagcc ccggcggccg ccgccgccca
 121  gaccggacga caggccacct cgtcggcgtc cgcccgagtc cccgcctcgc cgccaacgcc
 181  acaaccaccg cgcacggccc cctgactccg tccagtattg atcgggagag ccggagcgag
 241  ctcttcgggg agcagcgatg cgacccccg ggacggccgg ggcagcgctc ctggcgctgc
 301  tggctgcgct ctgcccggcg agtcgggctc tggaggaaaa gaaagtttgc caaggcacga
 361  gtaacaagct cacgcagttg ggcacttttg aagatcattt tctcagcctc cagaggatgt
 421  tcaataactg tgaggtggtc cttgggaatt tggaaattac ctatgtgcag aggaattatg
 481  atctttcctt cttaaagacc atccaggagg tggctggtta tgtcctcatt gccctcaaca
 541  cagtggagcg aattcctttg gaaaacctgc agatcatcag aggaaatatg tactacgaaa
 601  attcctatgc cttagcagtc ttatctaact atgatgcaaa taaaaccgga ctgaaggagc
 661  tgcccatgag aaatttacag ggccaaaagt gtgatccaag ctgtcccaat gggagctgct
 721  ggggtgcagg agaggagaac tgccagaaac tgaccaaaat catctgtgcc cagcagtgct
 781  ccgggcgctg ccgtggcaag tcccccagtg actgctgcca caaccagtgt gctgcaggct
 841  gcacaggccc ccgggagagc gactgcctgg tctgccgcaa attccgagac gaagccacgt
 901  gcaaggacac ctgcccccca ctcatgctct acaacccca cacgtaccag atggatgtga
 961  accccgaggg caaatacagc tttggtgcca cctgcgtgaa gaagtgtccc cgtaattatg
1021  tggtgacaga tcacggctcg tgcgtccgag cctgtggggc cgacagctat gagatggagg
1081  aagacggcgt ccgcaagtgt aagaagtgcg aagggccttg ccgcaaagtg tgtaacggaa
1141  taggtattgg tgaatttaaa gactcactct ccataaatgc tacgaatatt aaacacttca
1201  aaaactgcac ctccatcagt ggcgatctcc acatcctgcc ggtggcattt aggggtgact
1261  ccttcacaca tactcctcct ctggatccac aggaactgga tattctgaaa accgtaaagg
1321  aaatcacagg ttttttgctg attcaggctt ggcctgaaaa caggacggac ctccatgcct
1381  ttgagaacct agaaatcata cgcggcagga ccaagcaaca tggtcagttt tctcttgcag
1441  tcgtcagcct gaacataaca tccttgggat tacgctccct caaggagata agtgatggag
1501  atgtgataat tcaggaaac aaaaatttgt gctatgcaaa tacaataaac tggaaaaaac
1561  tgtttgggac ctccggtcag aaaaccaaaa ttataagcaa cagaggtgaa acagctgca
1621  aggccacagg ccaggtctgc catgccttgt gctcccccga gggctgctgg ggcccggagc
1681  ccagggactg cgtctcttgc cggaatgtca gccgaggcag ggaatgcgtg gacaagtgca
1741  accttctgga gggtgagcca agggagtttg tggagaactc tgagtgcata cagtgccacc
1801  cagagtgcct gcctcaggcc atgaacatca cctgcacagg acggggacca gacaactgta
1861  tccagtgtgc ccactacatt gacggccccc actgcgtcaa gacctgcccg gcaggagtca
1921  tgggagaaaa caacaccctg gtctggaagt acgcagacgc cggccatgtg tgccacctgt
1981  gccatccaaa ctgcacctac ggatgcactg gccaggtct gaaggctgt ccaacgaatg
2041  ggcctaagat cccgtccatc gccactggga tggtggggc cctcctcttg ctgctggtgg
2101  tggccctggg atcggcctc ttcatgcgaa ggcgccacat cgttcggaag cgcacgctgc
2161  ggaggctgct gcaggagagg gagcttgtgg agcctcttac acccagtgga gaagctccca
2221  accaagctct cttgaggatc ttgaaggaaa ctgaattcaa aaagatcaaa gtgctgggct
2281  ccggtgcgtt cggcacggtg tataagggac tctggatccc agaaggtgag aaagttaaaa
```

TABLE 1-continued

```
2341  ttcccgtcgc tatcaaggaa ttaagagaag caacatctcc gaaagccaac aaggaaatcc
2401  tcgatgaagc ctacgtgatg gccagcgtgg acaaccccca cgtgtgccgc ctgctgggca
2461  tctgcctcac ctccaccgtg cagctcatca cgcagctcat gcccttcggc tgcctcctgg
2521  actatgtccg ggaacacaaa gacaatattg ctcccagta cctgctcaac tggtgtgtgc
2581  agatcgcaaa gggcatgaac tacttggagg accgtcgctt ggtgcaccgc gacctggcag
2641  ccaggaacgt actggtgaaa acaccgcagc atgtcaagat cacagatttt gggctggcca
2701  aactgctggg tgcggaagag aaagaatacc atgcagaagg aggcaaagtg cctatcaagt
2761  ggatggcatt ggaatcaatt ttacacagaa tctatacccca ccagagtgat gtctggagct
2821  acggggtgac tgtttgggag ttgatgacct ttggatccaa gccatatgac ggaatccctg
2881  ccagcgagat ctcctccatc ctggagaaag gagaacgcct ccctcagcca cccatatgta
2941  ccatcgatgt ctacatgatc atggtcaagt gctggatgat agacgcagat agtcgcccaa
3001  agttccgtga gttgatcatc gaattctcca aaatggcccg agaccccccag cgctaccttg
3061  tcattcaggg ggatgaaaga atgcatttgc caagtcctac agactccaac ttctaccgtg
3121  ccctgatgga tgaagaagac atggacgacg tggtggatgc cgacgagtac ctcatcccac
3181  agcagggctt cttcagcagc ccctccacgt cacggactcc cctcctgagc tctctgagtg
3241  caaccagcaa caattccacc gtggcttgca ttgatagaaa tgggctgcaa agctgtccca
3301  tcaaggaaga cagcttcttg cagcgataca gctcagaccc cacaggcgcc ttgactgagg
3361  acagcataga cgacaccttc ctcccagtgc ctgaatacat aaaccagtcc gttcccaaaa
3421  ggcccgctgg ctctgtgcag aatcctgtct atcacaatca gcctctgaac cccgcgccca
3481  gcagagaccc acactaccag gaccccccaca gcactgcagt gggcaacccc gagtatctca
3541  acactgtcca gcccacctgt gtcaacagca cattcgacag ccctgcccac tgggcccaga
3601  aaggcagcca ccaaattagc ctggacaacc ctgactacca gcaggacttc ttccccaagg
3661  aagccaagcc aaatggcatc tttaagggct ccacagctga aaatgcagaa tacctaaggg
3721  tcgcgccaca aagcagtgaa tttattggag catgaccacg gaggatagta tgagccctaa
3781  aaatccagac tctttcgata cccaggacca agccacagca ggtcctccat cccaacagcc
3841  atgcccgcat tagctcttag acccacagac tggttttgca acgtttacac cgactagcca
3901  ggaagtactt ccacctcggg cacattttgg gaagttgcat tcctttgtct tcaaactgtg
3961  aagcatttac agaaacgcat ccagcaagaa tattgtccct ttgagcagaa atttatcttt
4021  caaagaggta tatttgaaaa aaaaaaaaag tatatgtgag gattttttatt gattggggat
4081  cttggagttt ttcattgtcg ctattgattt ttacttcaat gggctcttcc aacaaggaag
4141  aagcttgctg gtagcacttg ctaccctgag ttcatccagg cccaactgtg agcaaggagc
4201  acaagccaca agtcttccag aggatgcttg attccagtgg ttctgcttca aggcttccac
4261  tgcaaaacac taaagatcca agaaggcctt catggcccca gcaggccgga tcggtactgt
4321  atcaagtcat ggcaggtaca gtaggataag ccactctgtc ccttcctggg caaagaagaa
4381  acggagggga tggaattctt ccttagactt acttttgtaa aaatgtcccc acggtactta
4441  ctccccactg atggaccagt ggtttccagt catgagcgtt agactgactt gtttgtcttc
4501  cattccattg ttttgaaact cagtatgctg cccctgtctt gctgtcatga aatcagcaag
4561  agaggatgac acatcaaata ataactcgga ttccagccca cattggattc atcagcattt
4621  ggaccaatag cccacagctg agaatgtgga atacctaagg atagcaccgc ttttgttctc
4681  gcaaaaacgt atctcctaat ttgaggctca gatgaaatgc atcaggtcct ttggggcata
```

TABLE 1-continued

```
4741  gatcagaaga ctacaaaaat gaagctgctc tgaaatctcc tttagccatc accccaaccc
4801  cccaaaatta gtttgtgtta cttatggaag atagttttct ccttttactt cacttcaaaa
4861  gcttttact  caaagagtat atgttccctc caggtcagct gcccccaaac cccctcctta
4921  cgctttgtca cacaaaaagt gtctctgcct tgagtcatct attcaagcac ttacagctct
4981  ggccacaaca gggcatttta caggtgcgaa tgacagtagc attatgagta gtgtggaatt
5041  caggtagtaa atatgaaact agggtttgaa attgataatg ctttcacaac atttgcagat
5101  gttttagaag gaaaaagtt  ccttcctaaa ataatttctc tacaattgga agattggaag
5161  attcagctag ttaggagccc acctttttc  ctaatctgtg tgtgccctgt aacctgactg
5221  gttaacagca gtcctttgta aacagtgttt taaactctcc tagtcaatat ccaccccatc
5281  caatttatca aggaagaaat ggttcagaaa atattttcag cctacagtta tgttcagtca
5341  cacacacata caaaatgttc cttttgcttt taaagtaatt tttgactccc agatcagtca
5401  gagcccctac agcattgtta agaaagtatt tgattttgt  ctcaatgaaa ataaaactat
5461  attcatttcc actctattat gctctcaaat accctaagc  atctatacta gcctggtatg
5521  ggtatgaaag atacaaagat aaataaaaca tagtccctga ttctaagaaa ttcacaattt
5581  agcaaaggaa atggactcat agatgctaac cttaaaacaa cgtgacaaat gccagacagg
5641  acccatcagc caggcactgt gagagcacag agcagggagg ttgggtcctg cctgaggaga
5701  cctggaaggg aggcctcaca ggaggatgac caggtctcag tcagcgggga ggtggaaagt
5761  gcaggtgcat cagggggcacc ctgaccgagg aaacagctgc cagaggcctc cactgctaaa
5821  gtccacataa ggctgaggtc agtcacccta acaacctgc  tccctctaag ccaggggatg
5881  agcttggagc atcccacaag ttccctaaaa gttgcagccc ccaggggat  tttgagctat
5941  catctctgca catgcttagt gagaagacta cacaacattt ctaagaatct gagattttat
6001  attgtcagtt aaccacttc  attattcatt cacctcagga catgcagaaa tatttcagtc
6061  agaactggga acagaagga  cctacattct gctgtcactt atgtgtcaag aagcagatga
6121  tcgatgaggc aggtcagttg taagtgagtc acattgtagc attaaattct agtatttttg
6181  tagtttgaaa cagtaactta ataaagagc  aaaagctaaa aaaaaaaaaa aaaa
```

SEQ ID NO: 104 Human EGFR Amino Acid Sequence Isoform G (NP_001333828.1)

```
  1  mrpsgtagaa llallaalcp asraleekkv cqgtsnkltq lgtfedhfls lqrmfnncev
 61  vlgnleityv qrnydlsflk tigevagyvl ialntverip lenlqiirgn myyensyala
121  vlsnydankt glkelpmrnl qgqkcdpscp ngscwgagee ncqkltkiic aqqcsgrcrg
181  kspsdcchnq caagctgpre sdclvcrkfr deatckdtcp plmlynptty qmdvnpegky
241  sfgatcvkkc prnyvvtdhg scvracgads yemeedgvrk ckkcegperk vcngigigef
301  kdslsinatn ikhfknctsi sgdlhilpva frgdsfthtp pldpqeldil ktvkeitgfl
361  liqawpenrt dlhafenlei irgrtkqhgq fslavvslni tslglrslke isdgdviisg
421  nknlcyanti nwkklfgtsg qktkiisnrg ensckatgqv chalcspegc wgpeprdcvs
481  crnvsrgrec vdkcnllege prefvensec iqchpeclpq amnitctgrg pdnciqcahy
541  idgphcvktc pagvmgennt lvwkyadagh vchlchpnct ygctgpgleg cptngpkips
601  iatgmvgall lllvvalgig lfmrrrhivr krtlrrllqe relvepltps geapnqallr
661  ilketefkki kvlgsgafgt vykglwipeg ekvkipvaik elreatspka nkeildeayv
721  masvdnphvc rllgicltst vglitqlmpf gclldyvreh kdnigsqyll nwcvgiakgm
781  nyledrrlvh rdlaarnvlv ktpqhvkitd fglaklgae  ekeyhaeggk vpikwmales
841  ilhriythqs dvwsygvtvw elmtfgskpy dgipaseiss ilekgerlpq ppictidvym
```

TABLE 1-continued

```
 901 imvkcwmida dsrpkfreli iefskmardp grylviggde rmhlpsptds nfyralmdee
 961 dmddvvdade ylipqqgffs spstsrtpll sslsatsnns tvacidrngl qscpikedsf
1021 lqryssdptg altedsiddt flpvpeyinq svpkrpagsv qnpvyhnqpl npapsrdphy
1081 qdphstavgn peylntvqpt cvnstfdspa hwaqkgshqi sldnpdyqqd ffpkeakpng
1141 ifkgstaena eylrvapqss efiga
```

SEQ ID NO: 105 Human EGFR cDNA Sequence Variant 8 (NM_001346900.1, CDS: from 214 to 3687)

```
   1 cctttgaat gagctctaaa acagttctcc actggacttc agaacaagag ggagctctgg
  61 gctgctggct ggttgtgcat ttgctgtggg ttccctccgg caggcgacct ctccgcgctg
 121 agaaggttat ccggataacc aatttgccaa ggcacgagta acaagctcac gcagttgggc
 181 acttttgaag atcattttct cagcctccag aggatgttca ataactgtga ggtggtcctt
 241 gggaatttgg aaattaccta tgtgcagagg aattatgatc tttccttctt aaagaccatc
 301 caggaggtgg ctggttatgt cctcattgcc ctcaacacag tggagcgaat tcctttggaa
 361 aacctgcaga tcatcagagg aaatatgtac tacgaaaatt cctatgcctt agcagtctta
 421 tctaactatg atgcaaataa aaccggactg aaggagctgc catgagaaa tttacaggaa
 481 atcctgcatg gcgccgtgcg gttcagcaac aaccctgccc tgtgcaacgt ggagagcatc
 541 cagtggcggg acatagtcag cagtgactt ctcagcaaca tgtcgatgga cttccagaac
 601 cacctgggca gctgccaaaa gtgtgatcca agctgtccca tgggagctg ctggggtgca
 661 ggagaggaga actgccagaa actgaccaaa atcatctgtg cccagcagt ctccgggcgc
 721 tgccgtggca agtcccccag tgactgctgc cacaaccagt gtgctgcagg ctgcacaggc
 781 ccccgggaga gcgactgcct ggtctgccgc aaattccgag acgaagccac gtgcaaggac
 841 acctgccccc cactcatgct ctacaacccc accacgtacc agatggatgt gaacccgag
 901 ggcaaataca gctttggtgc cacctgcgtg aagaagtgtc ccgtaatta tgtggtgaca
 961 gatcacggct cgtgcgtccg agcctgtggg gccgacagct atgagatgga ggaagacggc
1021 gtccgcaagt gtaagaagtg cgaagggcct tgccgcaaag tgtgtaacgg aataggtatt
1081 ggtgaattta agactcact ctccataaat gctacgaata ttaaacactt caaaaactgc
1141 acctccatca gtggcgatct ccacatcctg ccggtggcat tagggggtga ctccttcaca
1201 catactcctc ctctggatcc acaggaactg gatattctga aaaccgtaaa ggaaatcaca
1261 gggttttgc tgattcaggc ttggcctgaa aacaggacgg acctccatgc ctttgagaac
1321 ctagaaatca tacgcggcag gaccaagcaa catggtcagt tttctcttgc agtcgtcagc
1381 ctgaacataa catccttggg attacgctcc ctcaaggaga taagtgatgg agatgtgata
1441 atttcaggaa acaaaaattt gtgctatgca aatacaataa actggaaaaa actgtttggg
1501 acctccggtc agaaaaccaa aattataagc aacagaggtg aaaacagctg caaggccaca
1561 ggccaggtct gcatgccttg tgctccccc gagggctgct ggggcccgga gcccagggac
1621 tgcgtctctt gccggaatgt cagccgaggc agggaatgcg tggacaagtg caaccttctg
1681 gagggtgagc caagggagtt tgtggagaac tctgagtgca tacagtgcca cccagagtgc
1741 ctgcctcagg ccatgaacat cacctgcaca ggacgggac cagacaactg tatccagtgt
1801 gcccactaca ttgacggccc ccactgcgtc aagacctgcc cggcaggagt catgggagaa
1861 aacaacaccc tggtctgaa gtacgcagac gccggccatg tgtgccacct gtgccatcca
1921 aactgcacct acggatgcac tgggccaggt cttgaaggct gtccaacgaa tgggcctaag
1981 atcccgtcca tcgccactgg gatggtgggg gccctcctct tgctgctggt ggtggccctg
```

TABLE 1-continued

```
2041  gggatcggcc tcttcatgcg aaggcgccac atcgttcgga agcgcacgct gcggaggctg
2101  ctgcaggaga gggagcttgt ggagcctctt acacccagtg gagaagctcc aaccaagct
2161  ctcttgagga tcttgaagga aactgaattc aaaaagatca aagtgctggg ctccggtgcg
2221  ttcggcacgg tgtataaggg actctggatc ccagaaggtg agaaagttaa aattcccgtc
2281  gctatcaagg aattaagaga agcaacatct ccgaaagcca acaaggaaat cctcgatgaa
2341  gcctacgtga tggccagcgt ggacaacccc cacgtgtgcc gcctgctggg catctgcctc
2401  acctccaccg tgcagctcat cacgcagctc atgcccttcg gctgcctcct ggactatgtc
2461  cgggaacaca agacaatat tggctcccag tacctgctca actggtgtgt gcagatcgca
2521  aagggcatga actacttgga ggaccgtcgc ttggtgcacc gcgacctggc agccaggaac
2581  gtactggtga aaacaccgca gcatgtcaag atcacagatt ttgggctggc caaactgctg
2641  ggtgcggaag agaaagaata ccatgcagaa ggaggcaaag tgcctatcaa gtggatggca
2701  ttggaatcaa ttttacacag aatctatacc caccagagtg atgtctggag ctacggggtg
2761  actgtttggg agttgatgac ctttggatcc aagccatatg acggaatccc tgccagcgag
2821  atctcctcca tcctggagaa aggagaacgc ctccctcagc cacccatatg taccatcgat
2881  gtctacatga tcatggtcaa gtgctggatg atagacgcag atagtcgccc aaagttccgt
2941  gagttgatca tcgaattctc caaaatggcc cgagaccccc agcgctacct tgtcattcag
3001  ggggatgaaa gaatgcattt gccaagtcct acagactcca acttctaccg tgccctgatg
3061  gatgaagaag acatggacga cgtggtggat gccgacgagt acctcatccc acagcagggc
3121  ttcttcagca gcccctccac gtcacggact cccctcctga gctctctgag tgcaaccagc
3181  aacaattcca ccgtggcttg cattgataga aatgggctgc aaagctgtcc catcaaggaa
3241  gacagcttct tgcagcgata cagctcagac cccacaggcg ccttgactga ggacagcata
3301  gacgacacct tcctcccagt gcctgaatac ataaaccagt ccgttcccaa aaggcccgct
3361  ggctctgtgc agaatcctgt ctatcacaat cagcctctga ccccgcgcc cagcagagac
3421  ccacactacc aggaccccca cagcactgca gtgggcaacc ccgagtatct caacactgtc
3481  cagcccacct gtgtcaacag cacattcgac agccctgccc actgggccca gaaaggcagc
3541  caccaaatta gcctggacaa ccctgactac cagcaggact tctttcccaa ggaagccaag
3601  ccaaatggca tctttaaggg ctccacagct gaaaatgcag aatacctaag ggtcgcgcca
3661  caaagcagtg aatttattgg agcatgacca cggaggatag tatgagccct aaaaatccag
3721  actctttcga tacccaggac caagccacag caggtcctcc atcccaacag ccatgcccgc
3781  attagctctt agacccacag actggttttg caacgtttac accgactagc caggaagtac
3841  ttccacctcg ggcacatttt gggaagttgc attcctttgt cttcaaactg tgaagcattt
3901  acagaaacgc atccagcaag aatattgtcc ctttgagcag aaatttatct ttcaaagagg
3961  tatatttgaa aaaaaaaaa agtatatgtg aggatttta ttgattggg atcttggagt
4021  ttttcattgt cgctattgat ttttacttca atgggctctt ccaacaagga agaagcttgc
4081  tggtagcact tgctaccctg agttcatcca ggcccaactg tgagcaagga gcacaagcca
4141  caagtcttcc agaggatgct tgattccagt ggttctgctt caaggcttcc actgcaaaac
4201  actaaagatc caagaaggcc ttcatggccc cagcaggccg gatcggtact gtatcaagtc
4261  atggcaggta cagtaggata agccactctg tcccttcctg ggcaaagaag aaacggaggg
4321  gatggaattc ttccttagac ttactttgt aaaaatgtcc ccacggtact tactccccac
4381  tgatggacca gtggtttcca gtcatgagcg ttagactgac ttgtttgtct tccattccat
```

TABLE 1-continued

```
4441  tgttttgaaa ctcagtatgc tgcccctgtc ttgctgtcat gaaatcagca agagaggatg
4501  acacatcaaa taataactcg gattccagcc cacattggat tcatcagcat ttggaccaat
4561  agcccacagc tgagaatgtg gaatacctaa ggatagcacc gcttttgttc tcgcaaaaac
4621  gtatctccta atttgaggct cagatgaaat gcatcaggtc ctttggggca tagatcagaa
4681  gactacaaaa atgaagctgc tctgaaatct cctttagcca tcacccccaac ccccaaaat
4741  tagtttgtgt tacttatgga agatagtttt ctccttttac ttcacttcaa aagcttttta
4801  ctcaaagagt atatgttccc tccaggtcag ctgcccccaa accccctcct tacgctttgt
4861  cacacaaaaa gtgtctctgc cttgagtcat ctattcaagc acttacagct ctggccacaa
4921  cagggcattt tacaggtgcg aatgacagta gcattatgag tagtgtggaa ttcaggtagt
4981  aaatatgaaa ctagggtttg aaattgataa tgcttcaca acatttgcag atgttttaga
5041  aggaaaaaag ttccttccta aaataatttc tctacaattg gaagattgga agattcagct
5101  agttaggagc ccacctttt tcctaatctg tgtgtgccct gtaacctgac tggttaacag
5161  cagtcctttg taaacagtgt tttaaactct cctagtcaat atccacccca tccaatttat
5221  caaggaagaa atggttcaga aaatatttc agcctacagt tatgttcagt cacacacaca
5281  tacaaaatgt tccttttgct tttaaagtaa tttttgactc ccagatcagt cagagcccct
5341  acagcattgt taagaaagta tttgatttt gtctcaatga aaataaaact atattcattt
5401  ccactctatt atgctctcaa ataccctaa gcatctatac tagcctggta tgggtatgaa
5461  agatacaaag ataaataaaa catagtccct gattctaaga aattcacaat ttagcaaagg
5521  aaatggactc atagatgcta accttaaaac aacgtgacaa atgccagaca ggacccatca
5581  gccaggcact gtgagagcac agagcaggga ggttgggtcc tgcctgagga gacctggaag
5641  ggaggcctca caggaggatg accaggtctc agtcagcggg gaggtggaaa gtgcaggtgc
5701  atcaggggca ccctgaccga ggaaacagct gccagaggcc tccactgcta aagtccacat
5761  aaggctgagg tcagtcaccc taaacaacct gctccctcta agccagggga tgagcttgga
5821  gcatcccaca agttccctaa aagttgcagc ccccaggggg attttgagct atcatctctg
5881  cacatgctta gtgagaagac tacacaacat ttctaagaat ctgagatttt atattgtcag
5941  ttaaccactt tcattattca ttcacctcag gacatgcaga aatatttcag tcagaactgg
6001  gaaacagaag gacctacatt ctgctgtcac ttatgtgtca agaagcagat gatcgatgag
6061  gcaggtcagt tgtaagtgag tcacattgta gcattaaatt ctagtatttt tgtagtttga
6121  aacagtaact taataaaaga gcaaaagcta aaaaaaaaaa aaaaaa
```

SEQ ID NO: 106 Human EGFR Amino Acid Sequence Isoform H (NP_001333829.1)

```
  1  mfnncevvlg nleityvqrn ydlsflktiq evagyvlial ntveriplen lqiirgnmyy
 61  ensyalavls nydanktglk elpmrnlqei lhgavrfsnn palcnvesiq wrdivssdfl
121  snmsmdfqnh lgscqkcdps cpngscwgag eencqkltki icaqqcsgrc rgkspsdcch
181  nqcaagctgp resdclvcrk frdeatckdt cpplmlynpt tyqmdvnpeg kysfgatcvk
241  kcprnyvvtd hgscvracga dsyemeedgv rkckkcegpc rkvcngigig efkdslsina
301  tnikhfknct sisgdlhilp vafrgdsfth tppldpgeld ilktvkeitg flliqawpen
361  rtdlhafenl eiirgrtkqh gqfslavvsl nitslglrsl keisdgdvii sgnknlcyan
421  tinwkklfgt sgqktkiisn rgensckatg qvchalcspe gcwgpeprdc vscrnvsrgr
481  ecvdkcnlle geprefvens eciqchpecl pqamnitctg rgpdncigca hyidgphcvk
541  tcpagvmgen ntivwkyada ghvchlchpn ctygctgpgl egcptngpki psiatgmvga
601  llllllvvalg iglfmrrrhi vrkrtlrrll qerelveplt psgeapngal lrilketefk
```

TABLE 1-continued

```
 661   kikvlgsgaf gtvykglwip egekvkipva ikelreatsp kankeildea yvmasvdnph
 721   vcrllgiclt stvglitqlm pfgclldyvr ehkdnigsqy llnwcvgiak gmnyledrrl
 781   vhrdlaarnv lvktpqhvki tdfglaklllg aeekeyhaeg gkvpikwmal esilhriyth
 841   qsdvwsygvt vwelmtfgsk pydgipasei ssilekgerl pqppictidv ymimvkcwmi
 901   dadsrpkfre liiefskmar dpqrylviqg dermhlpspt dsnfyralmd eedmddvvda
 961   deylipqqgf fsspstsrtp llsslsatsn nstvacidrn glqscpiked sflqryssdp
1021   tgaltedsid dtflpvpeyi nqsvpkrpag svqnpvyhnq pinpapsrdp hyqdphstav
1081   gnpeylntvg ptcvnstfds pahwaqkgsh gisldnpdyq qdffpkeakp ngifkgstae
1141   naeylrvapq ssefiga
```

SEQ ID NO: 107 Human EGFR cDNA Sequence Variant 9 (NM_001346941.1, CDS: from 258 to 3089)

```
   1   gtccgggcag ccccggcgc agcgcggccg cagcagcctc cgccccccgc acggtgtgag
  61   cgcccgacgc ggccgaggcg gccggagtcc cgagctagcc ccggcggccg ccgccgccca
 121   gaccggacga caggccacct cgtcggcgtc cgcccgagtc cccgcctcgc cgccaacgcc
 181   acaaccaccg cgcacggccc cctgactccg tccagtattg atcgggagag ccggagcgag
 241   ctcttcgggg agcagcgatg cgaccctccg ggacggccgg ggcagcgctc ctggcgctgc
 301   tggctgcgct ctgcccggcg agtcgggctc tggaggaaaa gaaaggtaat tatgtggtga
 361   cagatcacgg ctcgtgcgtc cgagcctgtg gggccgacag ctatgagatg gaggaagacg
 421   gcgtccgcaa gtgtaagaag tgcgaagggc cttgccgcaa agtgtgtaac ggaataggta
 481   ttggtgaatt taaagactca ctctccataa atgctacgaa tattaaacac ttcaaaaact
 541   gcacctccat cagtggcgat ctccacatcc tgccggtggc atttagggg gactccttca
 601   cacatactcc tcctctggat ccacaggaac tggatattct gaaaaccgta aggaaatca
 661   cagggttttt gctgattcag gcttggcctg aaaacaggac ggacctccat gcctttgaga
 721   acctagaaat catacgcggc aggaccaagc aacatggtca gttttctctt gcagtcgtca
 781   gcctgaacat aacatccttg ggattacgct ccctcaagga gataagtgat ggagatgtga
 841   taatttcagg aaacaaaaat ttgtgctatg caaatacaat aaactggaaa aaactgtttg
 901   ggacctccgg tcagaaaacc aaaattataa gcaacagagg tgaaaacagc tgcaaggcca
 961   caggccaggt ctgccatgcc ttgtgctccc ccgagggctg ctggggcccg agcccaggg
1021   actgcgtctc ttgccggaat gtcagccgag gcagggaatg cgtggacaag tgcaaccttc
1081   tggagggtga gccaagggag tttgtggaga actctgagtg catacagtgc acccagagt
1141   gcctgcctca ggccatgaac atcacctgca caggacgggg accagacaac tgtatccagt
1201   gtgcccacta cattgacggc ccccactgcg tcaagacctg cccggcagga gtcatgggag
1261   aaaacaacac cctggtctgg aagtacgcag acgccggcca tgtgtgccac ctgtgccatc
1321   caaactgcac ctacggatgc actgggccag tcttgaagg ctgtccaacg aatgggccta
1381   agatcccgtc catcgccact gggatggtgg gggcctcct cttgctgctg gtggtggccc
1441   tggggatcgg cctcttcatg cgaaggcgcc acatcgttcg gaagcgcacg ctgcggaggc
1501   tgctgcagga gagggagctt gtggagcctc ttacacccag tggagaagct cccaaccaag
1561   ctctcttgag gatcttgaag gaaactgaat tcaaaaagat caaagtgctg ggctccggtg
1621   cgttcggcac ggtgtataag ggactctgga tcccagaagg tgagaaagtt aaaattcccg
1681   tcgctatcaa ggaattaaga gaagcaacat ctcgaaagc caacaaggaa atcctcgatg
1741   aagcctacgt gatggccagc gtggacaacc cccacgtgtg ccgcctgctg ggcatctgcc
```

TABLE 1-continued

```
1801  tcacctccac cgtgcagctc atcacgcagc tcatgccctt cggctgcctc ctggactatg
1861  tccgggaaca caaagacaat attggctccc agtacctgct caactggtgt gtgcagatcg
1921  caaagggcat gaactacttg gaggaccgtc gcttggtgca ccgcgacctg gcagccagga
1981  acgtactggt gaaaacaccg cagcatgtca agatcacaga ttttgggctg ccaaaactgc
2041  tgggtgcgga agagaaagaa taccatgcag aaggaggcaa agtgcctatc aagtggatgg
2101  cattggaatc aattttacac agaatctata cccaccagag tgatgtctga agctacgggg
2161  tgactgtttg ggagttgatg acctttggat ccaagccata tgacggaatc cctgccagcg
2221  agatctcctc catcctggag aaaggagaac gcctccctca gccacccata tgtaccatcg
2281  atgtctacat gatcatggtc aagtgctgga tgatagacgc agatagtcgc ccaaagttcc
2341  gtgagttgat catcgaattc tccaaaatgg cccgagaccc ccagcgctac cttgtcattc
2401  aggggggatga agaatgcat ttgccaagtc ctacagactc caacttctac cgtgccctga
2461  tggatgaaga agacatggac gacgtggtgg atgccgacga gtacctcatc ccacagcagg
2521  gcttcttcag cagcccctcc acgtcacgga ctccctcct gagctctctg agtgcaacca
2581  gcaacaattc caccgtggct tgcattgata gaaatgggct gcaaagctgt cccatcaagg
2641  aagacagctt cttgcagcga tacagctcag accccacagg cgccttgact gaggacagca
2701  tagacgacac cttcctccca gtgcctgaat acataaacca gtccgttccc aaaaggcccg
2761  ctggctctgt gcagaatcct gtctatcaca atcagcctct gaaccccgcg cccagcagag
2821  acccacacta ccaggacccc cacagcactg cagtgggcaa ccccgagtat ctcaacactg
2881  tccagcccac ctgtgtcaac agcacattcg acagccctgc ccactgggcc cagaaaggca
2941  gccaccaaat tagcctggac aaccctgact accagcagga cttctttccc aaggaagcca
3001  agccaaatgg catctttaag ggctccacag ctgaaaatgc agaataccta agggtcgcgc
3061  cacaaagcag tgaatttatt ggagcatgac cacggaggat agtatgagcc taaaaatcc
3121  agactctttc gatacccagg accaagccac agcaggtcct ccatcccaac agccatgccc
3181  gcattagctc ttagacccac agactggttt tgcaacgttt acaccgacta gccaggaagt
3241  acttccacct cgggcacatt ttgggaagtt gcattccttt gtcttcaaac tgtgaagcat
3301  ttacagaaac gcatccagca agaatattgt ccctttgagc agaaatttat ctttcaaaga
3361  ggtatatttg aaaaaaaaaa aaagtatatg tgaggatttt tattgattgg ggatcttgga
3421  gttttcatt gtcgctattg attttttactt caatgggctc ttccaacaag gaagaagctt
3481  gctggtagca cttgctaccc tgagttcatc caggcccaac tgtgagcaag gagcacaagc
3541  cacaagtctt ccagaggatg cttgattcca gtggttctgc ttcaaggctt ccactgcaaa
3601  acactaaaga tccaagaagg ccttcatggc cccagcaggc cggatcggta ctgtatcaag
3661  tcatggcagg tacagtagga taagccactc tgtcccttcc tgggcaaaga agaaacggag
3721  gggatggaat tcttccttag acttactttt gtaaaaatgt ccccacggta cttactcccc
3781  actgatggac cagtggtttc cagtcatgag cgttagactg acttgtttgt cttccattcc
3841  attgttttga aactcagtat gctgcccctg tcttgctgtc atgaaatcag caagagagga
3901  tgacacatca aataataact cggattccag cccacattgg attcatcagc atttggacca
3961  atagcccaca gctgagaatg tggaatacct aaggatagca ccgcttttgt tctcgcaaaa
4021  acgtatctcc taatttgagg ctcagatgaa atgcatcagg tcctttgggg catgatcag
4081  aagactacaa aaatgaagct gctctgaaat ctcctttagc catcacccca accccccaaa
4141  attagtttgt gttacttatg gaagatagtt ttctcctttt acttcacttc aaaagctttt
```

TABLE 1-continued

```
4201  tactcaaaga gtatatgttc cctccaggtc agctgccccc aaacccctc cttacgcttt
4261  gtcacacaaa aagtgtctct gccttgagtc atctattcaa gcacttacag ctctggccac
4321  aacagggcat tttacaggtg cgaatgacag tagcattatg agtagtgtgg aattcaggta
4381  gtaaatatga aactagggtt tgaaattgat aatgctttca caacatttgc agatgtttta
4441  gaaggaaaaa agttccttcc taaaataatt tctctacaat tggaagattg aagattcag
4501  ctagttagga gcccaccttt tttcctaatc tgtgtgtgcc ctgtaacctg actggttaac
4561  agcagtcctt tgtaaacagt gttttaaact ctcctagtca atatccaccc catccaattt
4621  atcaaggaag aaatggttca gaaaatattt tcagcctaca gttatgttca gtcacacaca
4681  catacaaaat gttccttttg cttttaaagt aattttgac tcccagatca gtcagagccc
4741  ctacagcatt gttaagaaag tatttgattt ttgtctcaat gaaaataaaa ctatattcat
4801  ttccactcta ttatgctctc aaatacccct aagcatctat actagcctgg tatgggtatg
4861  aaagatacaa agataaataa acatagtcc ctgattctaa gaaattcaca atttagcaaa
4921  ggaaatggac tcatagatgc taaccttaaa acaacgtgac aaatgccaga caggacccat
4981  cagccaggca ctgtgagagc acagagcagg gaggttgggt cctgcctgag gagacctgga
5041  agggaggcct cacaggagga tgaccaggtc tcagtcagcg gggaggtgga aagtgcaggt
5101  gcatcagggg caccctgacc gaggaaacag ctgccagagg cctccactgc taaagtccac
5161  ataaggctga ggtcagtcac cctaaacaac ctgctccctc taagccaggg gatgagcttg
5221  gagcatccca caagttccct aaaagttgca gccccagggg ggattttgag ctatcatctc
5281  tgcacatgct tagtgagaag actacacaac atttctaaga atctgagatt ttatattgtc
5341  agttaaccac tttcattatt cattcacctc aggacatgca gaaatatttc agtcagaact
5401  gggaaacaga aggacctaca ttctgctgtc acttatgtgt caagaagcag atgatcgatg
5461  aggcaggtca gttgtaagtg agtcacattg tagcattaaa ttctagtatt tttgtagttt
5521  gaaacagtaa cttaataaaa gagcaaaagc ta
```

SEQ ID NO: 108 Human EGFR Amino Acid Sequence Isoform I (NP_001333870.1)
```
  1  mrpsgtagaa llallaalcp asraleekkg nyvvtdhgsc vracgadsye meedgvrkck
 61  kcegperkvc ngigigefkd slsinatnik hfkncctsisg dlhilpvafr gdsfthtppl
121  dpqeldilkt vkeitgflli qawpenrtdl hafenleiir grtkqhgqfs lavvslnits
181  lglrslkeis dgdviisgnk nlcyantinw kklfgtsgqk tkiisnrgen sckatgqvch
241  alcspegcwg peprdcvscr nvsrgrecvd kcnllegepr efvenseciq chpeclpqam
301  nitctgrgpd nciqcahyid gphcvktcpa gvmgenntiv wkyadaghvc hlchpnctyg
361  ctgpglegcp tngpkipsia tgmvgallll lvvalgiglf mrrrhivrkr tlrrllgere
421  lvepltpsge apnqallril ketefkkikv lgsgafgtvy kglwipegek vkipvaikel
481  reatspkank eildeayvma svdnphvcrl lgicltstvq litqlmpfgc lldyvrehkd
541  nigsqyllnw cvqiakgmny ledrrlvhrd laarnvlvkt pqhvkitdfg lakllgaeek
601  eyhaeggkvp ikwmalesil hriythqsdv wsygvtvwel mtfgskpydg ipaseissil
661  ekgerlpqpp ictidvymim vkcwmidads rpkfreliie fskmardpqr ylviqgderm
721  hlpsptdsnf yralmdeedm ddvvdadeyl ipqqgffssp stsrtpllss lsatsnnstv
781  acidrnglqs cpikedsflq ryssdptgal tedsiddtfl pvpeyingsv pkrpagsvqn
841  pvyhnqplnp apsrdphyqd phstavgnpe ylntvgptcv nstfdspahw aqkgshqisl
901  dnpdyqqdff pkeakpngif kgstaenaey lrvapqssef iga
```

TABLE 1-continued

SEQ ID NO: 109 Mouse EGFR cDNA Sequence Variant 1 (NM_207655.2, CDS: from 281 to 3913)

```
   1 ctcccccagt cccgacccga gctaactaga cgtctgggca gccccagcgc aacgcgcagc
  61 agcctccctc ctcttcttcc cgcactgtgc gctcctcctg ggctagggcg tctggatcga
 121 gtcccggagg ctaccgcctc ccagacagag acaggtcac ctggacgcga gcctgtgtcc
 181 gggtctcgtc gttgccggcg cagtcactgg gcacaaccgt gggactccgt ctgtctcgga
 241 ttaatcccgg agagccagag ccaacctctc ccggtcagag atgcgaccct cagggaccgc
 301 gagaaccaca ctgctggtgt tgctgaccgc gctctgcgcc gcaggtgggg cgttggagga
 361 aaagaaagtc tgccaaggca caagtaacag gctcacccaa ctgggcactt tgaagacca
 421 ctttctgagc ctgcagagga tgtacaacaa ctgtgaagtg gtccttggga acttggaaat
 481 tacctatgtg caaaggaatt acgacctttc cttcttaaag accatccagg aggtggccgg
 541 ctatgtcctc attgccctca caccgtggga gagaatccct ttggagaacc tgcagatcat
 601 caggggaaat gctctttatg aaaacaccta tgccttagcc atcctgtcca actatgggac
 661 aaacagaact gggcttaggg aactgcccat gcggaactta caggaaatcc tgattggtgc
 721 tgtgcgattc agcaacaacc ccatcctctg caatatggat actatccagt ggagggacat
 781 cgtccaaaac gtctttatga gcaacatgtc aatggactta cagagccatc cgagcagttg
 841 ccccaaatgt gatccaagct gtcccaatgg aagctgctgg ggaggaggag aggagaactg
 901 ccagaaattg accaaaatca tctgtgccca gcaatgttcc catcgctgtc gtggcaggtc
 961 ccccagtgac tgctgccaca ccaatgtgc tgcggggtgt acagggcccc gagagagtga
1021 ctgtctggtc tgccaaaagt tccaagatga ggccacatgc aaagacacct gcccaccact
1081 catgctgtac aaccccacca cctatcagat ggatgtcaac cctgaaggga gtacagctt
1141 tggtgccacc tgtgtgaaga agtgcccccg aaactacgtg gtgacagatc atggctcatg
1201 tgtccgagcc tgtgggcctg actactacga agtggaagaa gatggcatcc gcaagtgtaa
1261 aaaatgtgat gggccctgtc gcaaagtttg taatggcata ggcattggtg aatttaaaga
1321 cacactctcc ataaatgcta caaacatcaa acacttcaaa tactgcactg ccatcagcgg
1381 ggaccttcac atcctgccag tggcctttaa gggggattct ttcacgcgca ctcctcctct
1441 agacccacga gaactagaaa ttctaaaaac cgtaaaggaa ataacaggct ttttgctgat
1501 tcaggcttgg cctgataact ggactgacct ccatgctttc gagaacctag aaataatacg
1561 tggcagaaca aagcaacatg gtcagttttc tttggcggtc gttggcctga acatcacatc
1621 actggggctg cgttccctca aggagatcag tgatggggat gtgatcattt ctggaaaccg
1681 aaatttgtgc tacgcaaaca ataaactg gaaaaaactc ttcgggacac ccaatcagaa
1741 aaccaaaatc atgaacaaca gagctgagaa agactgcaag gccgtgaacc acgtctgcaa
1801 tcctttatgc tcctcggaag gctgctgggg ccctgagccc agggactgtg tctcctgcca
1861 gaatgtgagc agaggcaggg agtgcgtgga gaaatgcaac atcctggagg gggaaccaag
1921 ggagtttgtg gaaaattctg aatgcatcca gtgccatcca gaatgtctgc cccaggccat
1981 gaacatcacc tgtacaggca ggggaccaga caactgcatc cagtgtgccc actacattga
2041 tggcccacac tgtgtcaaga cctgcccagc tggcatcatg ggagagaaca cactctggt
2101 ctggaagtat gcagatgcca ataatgtctg ccaccctatgc cacgccaact gtacctatgg
2161 atgtgctggg ccaggtcttc aaggatgtga agtgtggcca tctgggccaa agataccatc
2221 tattgccact gggattgtgg gtggcctcct cttcatagtg gtggtggccc ttgggattgg
2281 cctattcatg cgaagacgtc acattgttcg aaagcgtaca ctacgccgcc tgcttcaaga
```

TABLE 1-continued

```
2341  gagagagctc gtggaacctc tcacacccag cggagaagct ccaaaccaag cccacttgag
2401  gatattaaag gaaacagaat tcaaaaagat caaagttctg ggttcgggag catttggcac
2461  agtgtataag ggtctctgga tcccagaagg tgagaaagta aaaatcccgg tggccatcaa
2521  ggagttaaga gaagccacat ctccaaaagc caacaaagaa tccttgacg  aagcctatgt
2581  gatggctagt gtggacaacc ctcatgtatg ccgcctcctg ggcatctgtc tgacctccac
2641  tgtccagctc attacacagc tcatgcccta cggttgcctc ctggactacg tccgagaaca
2701  caaggacaac attggctccc agtacctcct caactggtgt gtgcagattg caaagggcat
2761  gaactacctg gaagatcggc gtttggtgca ccgtgacttg gcagccagga atgtactggt
2821  gaagacacca cagcatgtca agatcacaga ttttgggctg ccaaactgc  ttggtgctga
2881  agagaaagaa tatcatgccg aggggggcaa agtgcctatc aagtggatgg ctttggaatc
2941  aattttacac cgaatttata cacaccaaag tgatgtctgg agctatggtg tcactgtgtg
3001  ggaactgatg acctttgggt ccaagcctta tgatggaatc ccagcaagtg acatctcatc
3061  catcctagag aaaggagagc gccttccaca gccacctatc tgcaccatcg atgtctacat
3121  gatcatggtc aagtgctgga tgatagatgc tgatagccgc ccaaagttcc gagagttgat
3181  tcttgaattc tccaaaatgg cccgagaccc acagcgctac cttgttatcc aggggatga
3241  aagaatgcat ttgccaagcc ctacagactc caacttttac cgagccctga tggatgaaga
3301  ggacatggag gatgtagttg atgctgatga gtatcttatc ccacagcaag gcttcttcaa
3361  cagcccgtcc acgtcgagga ctcccctctt gagttctctg agtgcaacta gcaacaattc
3421  cactgtggct tgcattaata gaaatgggag ctgccgtgtc aaagaagacg ccttcttgca
3481  gcggtacagc tccgaccccca caggtgctgt aacagaggac aacatagatg acgcattcct
3541  ccctgtacct gaatatgtaa accaatctgt tcccaagagg ccagcaggct ctgtgcagaa
3601  ccctgtctat cacaatcagc ccctgcatcc agctcctgga agagacctgc attatcaaaa
3661  tccccacagc aatgcagtgg gcaaccctga gtatctcaac actgccagc  ctacctgtct
3721  cagtagtggg tttaacagcc ctgcactctg gatccagaaa ggcagtcacc aaatgagcct
3781  agacaacccct gactaccagc aggacttctt ccccaaggaa accaagccaa atggcatatt
3841  taagggcccc acagctgaaa atgcagagta cctacgggtg gcacctccaa gcagtgagtt
3901  tattggagca tgacaagaag gggcatcata ccagctataa aatgtctgga ctttctagaa
3961  tcccaggacc aactatggca gcacctccac ttctggtagc atgcccacg  ctgtgtcaaa
4021  tgtcactcag actggcttta aagcataact ctgatgggct ttgtcactga gccaagaagt
4081  gggcctctct cctgatgcac tttgggaagt tgaaggtaca tcaattgatc ttcgaactgt
4141  gaagattcca caaaaaaggt atccatcgag aacattgtcc attggaacag aagtttgcct
4201  catggtgagg tacatatggg aaaaaaacag acatatggag cttatattta gggaactttg
4261  ggattcttgt ctttattgat ttgattgatg cactcttgta gtctggtaca cagagttgcc
4321  tggagccaac tgaccagaca gttggttcca ccagctctgc atcaagacac ttccgtggca
4381  agacaactaa atgtataaga agtccatgga tgccctgagc aggccacact tgtacagcat
4441  taaccatgg  cagatacaat aggataagcc actttgttac ttactgggc  tgggagaaga
4501  ggaatgacgg ggtagaattt tccctcagac gtactttta  tataaatatg tccctggcac
4561  ctaacacgcg ctagtttacc agtgttttct attagacttc cttctatgtt ttctgtttca
4621  ttgttttgag ttgtaaatat gtgttcctgt cttcatttca tgaagtaaac aaacaaacaa
4681  aaacccagt  attaagtatt atcaaagaac aaccatgatt ccacattcga acccattcaa
```

TABLE 1-continued

```
4741  accatcagta ttgtgaccaa aagcctttaa ctaagaagga gtaaccatgc aaaaatccat
4801  agaggaattt aacccaaaat tttagtctca gcattgtgtc tgctgaggtg tgtatatgag
4861  actacgaaag tgaactactc ttcaaatcca ctttgccttc actcctctat accctaaatc
4921  tagtgtaaac cacacatgga ggataacttt ttttttaat tttaaaagtg tttattagat
4981  atgttttct tcctggtaaa ctgcagccaa acatcagtta agagccattt ttgataaaca
5041  ctatcacaat gatctcggga tccatccttt ccgatttacc aagtgatgga tagacgtgaa
5101  ctcataaaca ctacccataa gacaaaacaa tgagtgccag acaagacatc agccaggcac
5161  cagagcacag agcaggactg ggcaatctgt tggagatatc tagaaagttc acaaaggaaa
5221  caagattgtc cactaccttg tgagatctag cagtcataaa taccagggaa atggaaagtg
5281  tgtttcctta cagcaccagg tcttcgatct tcctaatgct gtgacccttt aatacagttt
5341  gccatgttgt ggtgaccccc aaccataaaa ttatttttgt tgctacttca taactgtaaa
5401  tttgctactc ttacagacca caatgtaaat atctgatatg ctatctgata tgcaggctat
5461  ctgacagagg tcgcaacccg caggttgaga gccactgcct tcaaggcttt aatcaagaga
5521  gtagtgagct gagggcttta ctggtaagtc aggggcaagt ccaactcaat catcctcaca
5581  tactggctgc tccctcaggc ctgagaatga ggcttgcagc atcctctggt ttcctaaccg
5641  ttatccatcc ctgactctca tctctgaaaa tagatgtcat ccatgaaatt aaggagtgag
5701  aatattaagc agcatttata gagctcaaaa ttccatgtca tcaccaggaa gtgccatgtt
5761  gatcacagag aacacagagg agacatatag acagggtttt gctcaaaatt gggatataga
5821  atgagcctgt caggtaccta tcaggagcgg taatccgtga gagagaaccg ttgcaagcca
5881  ctctaactgt agcaatgaaa ccctagtatt tttgtacttt gaaatacttt cttataacaa
5941  aataaagtag caaaaaaact gttcaaaaaa aaaaaaaaaa aaa
```

SEQ ID NO: 110 Mouse EGFR Amino Acid Sequence Isoform A (NP_997538.1)
```
   1  mrpsgtartt llvlltalca aggaleekkv cqgtsnrltq lgtfedhfls lqrmynncev
  61  vlgnleityv qrnydlsflk tigevagyvl ialntverip lenlqiirgn alyentyala
 121  ilsnygtnrt glrelpmrnl qeiligavrf snnpilcnmd tiqwrdivqn vfmsnmsmdl
 181  qshpsscpkc dpscpngscw gggeencqkl tkiicaqqcs hrcrgrspsd cchnqcaagc
 241  tgpresdclv cqkfqdeatc kdtcpplmly npttyqmdvn pegkysfgat cvkkcprnyv
 301  vtdhgscvra cgpdyyevee dgirkckkcd gpcrkvcngi gigefkdtls inatnikhfk
 361  yctaisgdlh ilpvafkgds ftrtppldpr eleilktvke itgflliqaw pdnwtdlhaf
 421  enleiirgrt kqhgqfslav vglnitslgl rslkeisdgd viisgnrnlc yantinwkkl
 481  fgtpnqktki mnnraekdck avnhvcnplc ssegcwgpep rdcvscqnvs rgrecvekcn
 541  ilegeprefv enseciqchp eclpqamnit ctgrgpdnci qcahyidgph cvktcpagim
 601  gennтivwky adannvchlc hanctygcag pglqgcevwp sgpkipsiat givggllfiv
 661  vvalgiglfm rrrhivrkrt lrrllgerel vepltpsgea pnqahlrilk etefkkikvl
 721  gsgafgtvyk glwipegekv kipvaikelr eatspkanke ildeayvmas vdnphvcrll
 781  gicltstvql itqlmpygcl ldyvrehkdn igsqyllnwc vgiakgmnyl edrrlvhrdl
 841  aarnvlvktp qhvkitdfgl akllgaeeke yhaeggkvpi kwmalesilh riythqsdvw
 901  sygvtvwelm tfgskpydgi pasdissile kgerlpqppi ctidvymimv kcwmidadsr
 961  pkfrelilef skmardpqry lviqgdermh lpsptdsnfy ralmdeedme dvvdadeyli
1021  pqggffnsps tsrtpllssl satsnnstva cinrngscry kedaflqrys sdptgavted
1081  niddaflpvp eyvnqsvpkr pagsvqnpvy hnqplhpapg rdlhygnphs navgnpeyln
```

TABLE 1-continued

```
1141 taqptclssg fnspalwiqk gshqmsldnp dyqqdffpke tkpngifkgp taenaeylry 1201 appssefiga
```

SEQ ID NO: 111 Mouse EGFR cDNA Sequence Variant 2 (NM_007912.4, CDS: from 281 to 2248)

```
   1 ctcccccagt cccgacccga gctaactaga cgtctgggca gccccagcgc aacgcgcagc 61 agcctccctc ctcttcttcc cgcactgtgc gctcctcctg ggctagggcg tctggatcga 121 gtcccggagg ctaccgcctc ccagacagac gacaggtcac ctggacgcga gcctgtgtcc 181 gggtctcgtc gttgccggcg cagtcactgg gcacaaccgt gggactccgt ctgtctcgga 241 ttaatcccgg agagccagag ccaacctctc ccggtcagag atgcgaccct cagggaccgc 301 gagaaccaca ctgctggtgt tgctgaccgc gctctgcgcc gcaggtgggg cgttggagga 361 aaagaaagtc tgccaaggca caagtaacag gctcacccaa ctgggcactt ttgaagacca 421 ctttctgagc ctgcagagga tgtacaacaa ctgtgaagtg gtccttggga acttggaaat 481 tacctatgtg caaaggaatt acgacctttc cttcttaaag accatccagg aggtggccgg 541 ctatgtcctc attgccctca acaccgtgga gagaatccct ttggagaacc tgcagatcat 601 caggggaaat gctctttatg aaaacaccta tgccttagcc atcctgtcca actatgggac 661 aaacagaact gggcttaggg aactgcccat gcggaactta caggaaatcc tgattggtgc 721 tgtgcgattc agcaacaacc ccatcctctg caatatggat actatccagt ggagggacat 781 cgtccaaaac gtctttatga gcaacatgtc aatggactta cagagccatc cgagcagttg 841 ccccaaatgt gatccaagct gtcccaatgg aagctgctgg ggaggaggag aggagaactg 901 ccagaaattg accaaaatca tctgtgccca gcaatgttcc catcgctgtc gtggcaggtc 961 ccccagtgac tgctgccaca accaatgtgc tgcggggtgt acagggcccc gagagagtga 1021 ctgtctggtc tgccaaaagt tccaagatga ggccacatgc aaagacacct gcccaccact 1081 catgctgtac aaccccacca cctatcagat ggatgtcaac cctgaaggga gtacagctt 1141 tggtgccacc tgtgtgaaga agtgcccccg aaactacgtg gtgacagatc atggctcatg 1201 tgtccgagcc tgtgggcctg actactacga agtggaagaa gatggcatcc gcaagtgtaa 1261 aaaatgtgat gggccctgtc gcaaagtttg taatggcata ggcattggtg aatttaaaga 1321 cacactctcc ataaatgcta caaacatcaa acacttcaaa tactgcactg ccatcagcgg 1381 ggaccttcac atcctgccag tggcctttaa gggggattct ttcacgcgca ctcctcctct 1441 agacccacga gaactagaaa ttctaaaaac cgtaaaggaa ataacaggct ttttgctgat 1501 tcaggcttgg cctgataact ggactgacct ccatgctttc gagaacctag aaataatacg 1561 tggcagaaca aagcaacatg gtcagttttc tttggcggtc gttggcctga acatcacatc 1621 actggggctg cgttccctca aggagatcag tgatgggat gtgatcattt ctggaaaccg 1681 aaatttgtgc tacgcaaaca caataaactg gaaaaaactc ttcgggacac ccaatcagaa 1741 aaccaaaatc atgaacaaca gagctgagaa agactgcaag gccgtgaacc acgtctgcaa 1801 tcctttatgc tcctcggaag gctgctgggg ccctgagccc agggactgtg tctcctgcca 1861 gaatgtgagc agaggcaggg agtgcgtgga aaatgcaac atcctggagg ggaaccaag 1921 ggagtttgtg gaaaattctg aatgcatcca gtgccatcca gaatgtctgc cccaggccat 1981 gaacatcacc tgtacaggca ggggaccaga caactgcatc cagtgtgccc actacattga 2041 tggcccacac tgtgtcaaga cctgcccagc tggcatcatg ggagagaaca acactctggt 2101 ctggaagtat gcagatgcca ataatgtctg ccacctatgc cacgccaact gtacctatgg 2161 atgtgctggg ccaggtcttc aaggatgtga agtgtggcca tctgggtacg ttcaatggca
```

TABLE 1-continued

```
2221  gtggatctta aagaccttt ggatctaaga ccagaagcca tctctgactc ccctctcacc 2281  ttccagtttc ttccaaatcc tctgggccag ccagaggtct cagattctgc cctcttgccc 2341  tgtgcccacc ttgttgacca ctggacagca tatgtgatgg ctactgctag tgccagcttc 2401  acaagaggtt aacactacgg actagccatt cttcctatgt atctgtttct gcaaatacag 2461  ccgctttact taagtctcag cacttcttag tctcctcttt tcctctcagt agcccaaggg 2521  gtcatgtcac aaacatggtg tgaagggcta ctttgtcaaa tgaaaaggtc tatcttgggg 2581  ggcattttt tcttttcttt ttttcttgaa acacattgcc cagcaaagcc aataaatttc 2641  tctcatcatt ttgtttctga taaattctta ctattgat
```

SEQ ID NO: 112 Mouse EGFR Amino Acid Sequence Isoform B (NP_031938.1)
```
  1  mrpsgtartt llvlltalca aggaleekkv cqgtsnrltq lgtfedhfls lqrmynncev 61  vlgnleityv qrnydlsflk tigevagyvl ialntverip lenlqiirgn alyentyala 121  ilsnygtnrt glrelpmrnl qeiligavrf snnpilcnmd tiqwrdivqn vfmsnmsmdl 181  qshpsscpkc dpscpngscw gggeencqkl tkiicaqqcs hrcrgrspsd cchnqcaagc 241  tgpresdclv cqkfqdeatc kdtcpplmly nptyqmdvn pegkysfgat cvkkcprnyv 301  vtdhgscvra cgpdyyevee dgirkckkcd gpcrkvcngi gigefkdtls inatnikhfk 361  yctaisgdlh ilpvafkgds ftrtppldpr eleilktvke itgflliqaw pdnwtdlhaf 421  enleiirgrt kqhgqfslav vglnitslgl rslkeisdgd viisgnrnlc yantinwkkl 481  fgtpnqktki mnnraekdck avnhvcnplc ssegcwgpep rdcvscqnvs rgrecvekcn 541  ilegeprefv enseciqchp eclpqamnit ctgrgpdnci qcahyidgph cvktcpagim 601  genntivwky adannvchlc hanctygcag pglqgcevwp sgyvqwqwil ktfwi
```

Included in Table 1 are RNA nucleic acid molecules (e.g., thymines replaced with uredines), nucleic acid molecules encoding orthologs of the encoded proteins, as well as DNA or RNA nucleic acid sequences comprising a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with the nucleic acid sequence of any SEQ ID NO or biomarker described in Table 1 (see below for example), or a portion thereof. Such nucleic acid molecules can have a function of the full-length nucleic acid as described further herein.

Included in Table 1 are orthologs of the proteins, as well as polypeptide molecules comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with an amino acid sequence of any SEQ ID NO or biomarker described in Table 1 (see below for example), or a portion thereof. Such polypeptides can have a function of the full-length polypeptide as described further herein.

Included in Table 1 are one or more subunits of a SWI/SNF complex like BAF or PBAF, and mutations within the one more more subunits. In some embodiments, the biomarkers are a class of mutations encompassing the one or more subunits of a SWI/SNF complex, such as the class of synonymous and/or non-synonymous mutations of ARID2 and/or PBRM1, or the class of loss-of-function mutations for biomarkers shown in Tables 4-5. In other embodiment, the biomarkers are particular mutations of one or more subunits of a SWI/SNF complex, such as particular mutations described in the Tables and Examples (e.g., Tables 4-5). Thus, included in Table 1 is, for example, PBRM1, ARID2, BRD7, PHF10, KDM6A, ARID1A, ARID1B, BRG1, BRM, CRB1, and or EGFR, including any cDNA or polypeptide of PBRM1, ARID2, BRD7, PHF10, KDM6A, ARID1A, ARID1B, BRG1, BRM, CRB1, and EGFR. Similarly, included in Table 1 is, for example, PBRM1, ARID2, BRD7, PHF10, KDM6A, ARID1A, ARID1B, BRG1, BRM, CRB1, and EGFR nucleic acid and/or amino acid sequences encoding or representing PBRM1, ARID2, BRD7, PHF10, KDM6A, ARID1A, ARID1B, BRG1, BRM, CRB1, and EGFR having reduced or eliminated function (e.g., truncating mutations causing encoding of incomplete protein of PBRM1, ARID2, BRD7, PHF10, KDM6A, ARID1A, ARID1B, BRG1, BRM, CRB1, and EGFR). Many of these mutations were found in subjects having cancer and who were insensitive to immune checkpoint therapies. It is further determined that EGFR as a biomarker of immune checkpoint efficacy acts in opposite fashion to the other biomarkers described in Table 1 such that EGFR is mutated more frequently (e.g., hotspot mutations) in non-responders or less efficacious responders to immune checkpoint therapy rather than more frequently in subjects who respond to immune checkpoint therapy.

II. Subjects

In one embodiment, the subject for whom predicted likelihood of efficacy of an immune checkpoint therapy is determined, is a mammal (e.g., mouse, rat, primate, non-human mammal, domestic animal, such as a dog, cat, cow, horse, and the like), and is preferably a human.

In another embodiment of the methods of the present invention, the subject has not undergone treatment, such as chemotherapy, radiation therapy, targeted therapy, and/or immune checkpoint therapy. In still another embodiment, the subject has undergone treatment, such as chemotherapy, radiation therapy, targeted therapy, and/or immune checkpoint therapy.

In certain embodiments, the subject has had surgery to remove cancerous or precancerous tissue. In other embodiments, the cancerous tissue has not been removed, e.g., the cancerous tissue may be located in an inoperable region of the body, such as in a tissue that is essential for life, or in a region where a surgical procedure would cause considerable risk of harm to the patient.

The methods of the present invention can be used to determine the responsiveness to anti-immune checkpoint therapies of a cancer. In one embodiment, the cancer is one for which an immune checkpoint therapy (e.g., anti-PD-1 blocking antibody, anti-PD-L1 blocking antibody, CTLA-4 blocking antibody, and the like) is FDA-approved for treatment, such as those described in the Examples. In one embodiment, the cancers are solid tumors, such as lung cancer such as non-small cell lung cancer, bladder cancer, melanoma such as metastatic melanoma, and/or renal cell carcinoma. In another embodiment, the cancer is an epithelial cancer such as, but not limited to, brain cancer (e.g., glioblastomas) bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In still other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, brenner, or undifferentiated. In yet other embodiments, the cancer is a mesenchymal cancer, such as sarcoma.

III. Sample Collection, Preparation and Separation

In some embodiments, biomarker amount and/or activity measurement(s) in a sample from a subject is compared to a predetermined control (standard) sample. The sample from the subject is typically from a diseased tissue, such as cancer cells or tissues. The control sample can be from the same subject or from a different subject. The control sample is typically a normal, non-diseased sample. However, in some embodiments, such as for staging of disease or for evaluating the efficacy of treatment, the control sample can be from a diseased tissue. The control sample can be a combination of samples from several different subjects. In some embodiments, the biomarker amount and/or activity measurement(s) from a subject is compared to a pre-determined level. This pre-determined level is typically obtained from normal samples. As described herein, a "pre-determined" biomarker amount and/or activity measurement(s) may be a biomarker amount and/or activity measurement(s) used to, by way of example only, evaluate a subject that may be selected for treatment, evaluate a response to an immune checkpoint therapy, and/or evaluate a response to a combination immune checkpoint therapy. A pre-determined biomarker amount and/or activity measurement(s) may be determined in populations of patients with or without cancer. The pre-determined biomarker amount and/or activity measurement(s) can be a single number, equally applicable to every patient, or the pre-determined biomarker amount and/or activity measurement(s) can vary according to specific subpopulations of patients. Age, weight, height, and other factors of a subject may affect the pre-determined biomarker amount and/or activity measurement(s) of the individual. Furthermore, the pre-determined biomarker amount and/or activity can be determined for each subject individually. In one embodiment, the amounts determined and/or compared in a method described herein are based on absolute measurements.

In another embodiment, the amounts determined and/or compared in a method described herein are based on relative measurements, such as ratios (e.g., biomarker copy numbers, level, and/or activity before a treatment vs. after a treatment, such biomarker measurements relative to a spiked or man-made control, such biomarker measurements relative to the expression of a housekeeping gene, and the like). For example, the relative analysis can be based on the ratio of pre-treatment biomarker measurement as compared to post-treatment biomarker measurement. Pre-treatment biomarker measurement can be made at any time prior to initiation of anti-cancer therapy. Post-treatment biomarker measurement can be made at any time after initiation of anti-cancer therapy. In some embodiments, post-treatment biomarker measurements are made 1, 2, 3, 4, 5, 6, 7, 8, 9, 10, 11, 12, 13, 14, 15, 16, 17, 18, 19, 20 weeks or more after initiation of anti-cancer therapy, and even longer toward indefinitely for continued monitoring. Treatment can comprise anti-cancer therapy, such as a therapeutic regimen comprising an anti-PD1 monoclonal antibody (e.g., nivolumab) alone or in combination with other anti-cancer agents, such as anti-PD-L1/PD-L2 antibodies, anti-VEGF agents (e.g., bevacizumab), agents described in the Examples, Figures, and Tables, or anti-PBRM1 (or anti-ARID2, anti-BRD7, anti-PHF10, or anti-KDM6A) agents.

The pre-determined biomarker amount and/or activity measurement(s) can be any suitable standard. For example, the pre-determined biomarker amount and/or activity measurement(s) can be obtained from the same or a different human for whom a patient selection is being assessed. In one embodiment, the pre-determined biomarker amount and/or activity measurement(s) can be obtained from a previous assessment of the same patient. In such a manner, the progress of the selection of the patient can be monitored over time. In addition, the control can be obtained from an assessment of another human or multiple humans, e.g., selected groups of humans, if the subject is a human. In such a manner, the extent of the selection of the human for whom selection is being assessed can be compared to suitable other humans, e.g., other humans who are in a similar situation to the human of interest, such as those suffering from similar or the same condition(s) and/or of the same ethnic group.

In some embodiments of the present invention the change of biomarker amount and/or activity measurement(s) from the pre-determined level is about 0.1, 0.2, 0.3, 0.4, 0.5, 0.6, 0.7, 0.8, 0.9, 1.0, 1.5, 2.0, 2.5, 3.0, 3.5, 4.0, 4.5, or 5.0 fold or greater, or any range in between, inclusive. Such cutoff values apply equally when the measurement is based on relative changes, such as based on the ratio of pre-treatment biomarker measurement as compared to post-treatment biomarker measurement.

Biological samples can be collected from a variety of sources from a patient including a body fluid sample, cell sample, or a tissue sample comprising nucleic acids and/or proteins. "Body fluids" refer to fluids that are excreted or secreted from the body as well as fluids that are normally not (e.g., amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit). In a preferred embodiment, the subject and/or control sample is selected from the group consisting of cells, cell lines, histological slides, paraffin embedded tissues, biopsies, whole blood, nipple aspirate, serum, plasma, buccal scrape, saliva, cerebrospinal fluid, urine, stool, and bone marrow. In one embodiment, the sample is serum, plasma, or urine. In another embodiment, the sample is serum.

The samples can be collected from individuals repeatedly over a longitudinal period of time (e.g., once or more on the order of days, weeks, months, annually, biannually, etc.). Obtaining numerous samples from an individual over a period of time can be used to verify results from earlier detections and/or to identify an alteration in biological pattern as a result of, for example, disease progression, drug treatment, etc. For example, subject samples can be taken and monitored every month, every two months, or combinations of one, two, or three month intervals according to the present invention. In addition, the biomarker amount and/or activity measurements of the subject obtained over time can be conveniently compared with each other, as well as with those of normal controls during the monitoring period, thereby providing the subject's own values, as an internal, or personal, control for long-term monitoring.

Sample preparation and separation can involve any of the procedures, depending on the type of sample collected and/or analysis of biomarker measurement(s). Such procedures include, by way of example only, concentration, dilution, adjustment of pH, removal of high abundance polypeptides (e.g., albumin, gamma globulin, and transferrin, etc.), addition of preservatives and calibrants, addition of protease inhibitors, addition of denaturants, desalting of samples, concentration of sample proteins, extraction and purification of lipids.

The sample preparation can also isolate molecules that are bound in non-covalent complexes to other protein (e.g., carrier proteins). This process may isolate those molecules bound to a specific carrier protein (e.g., albumin), or use a more general process, such as the release of bound molecules from all carrier proteins via protein denaturation, for example using an acid, followed by removal of the carrier proteins.

Removal of undesired proteins (e.g., high abundance, uninformative, or undetectable proteins) from a sample can be achieved using high affinity reagents, high molecular weight filters, ultracentrifugation and/or electrodialysis. High affinity reagents include antibodies or other reagents (e.g., aptamers) that selectively bind to high abundance proteins. Sample preparation could also include ion exchange chromatography, metal ion affinity chromatography, gel filtration, hydrophobic chromatography, chromatofocusing, adsorption chromatography, isoelectric focusing and related techniques. Molecular weight filters include membranes that separate molecules on the basis of size and molecular weight. Such filters may further employ reverse osmosis, nanofiltration, ultrafiltration and microfiltration.

Ultracentrifugation is a method for removing undesired polypeptides from a sample. Ultracentrifugation is the centrifugation of a sample at about 15,000-60,000 rpm while monitoring with an optical system the sedimentation (or lack thereof) of particles. Electrodialysis is a procedure which uses an electromembrane or semipermeable membrane in a process in which ions are transported through semi-permeable membranes from one solution to another under the influence of a potential gradient. Since the membranes used in electrodialysis may have the ability to selectively transport ions having positive or negative charge, reject ions of the opposite charge, or to allow species to migrate through a semipermable membrane based on size and charge, it renders electrodialysis useful for concentration, removal, or separation of electrolytes.

Separation and purification in the present invention may include any procedure known in the art, such as capillary electrophoresis (e.g., in capillary or on-chip) or chromatography (e.g., in capillary, column or on a chip). Electrophoresis is a method which can be used to separate ionic molecules under the influence of an electric field. Electrophoresis can be conducted in a gel, capillary, or in a microchannel on a chip. Examples of gels used for electrophoresis include starch, acrylamide, polyethylene oxides, agarose, or combinations thereof. A gel can be modified by its cross-linking, addition of detergents, or denaturants, immobilization of enzymes or antibodies (affinity electrophoresis) or substrates (zymography) and incorporation of a pH gradient. Examples of capillaries used for electrophoresis include capillaries that interface with an electrospray.

Capillary electrophoresis (CE) is preferred for separating complex hydrophilic molecules and highly charged solutes. CE technology can also be implemented on microfluidic chips. Depending on the types of capillary and buffers used, CE can be further segmented into separation techniques such as capillary zone electrophoresis (CZE), capillary isoelectric focusing (CIEF), capillary isotachophoresis (cITP) and capillary electrochromatography (CEC). An embodiment to couple CE techniques to electrospray ionization involves the use of volatile solutions, for example, aqueous mixtures containing a volatile acid and/or base and an organic such as an alcohol or acetonitrile.

Capillary isotachophoresis (cITP) is a technique in which the analytes move through the capillary at a constant speed but are nevertheless separated by their respective mobilities. Capillary zone electrophoresis (CZE), also known as free-solution CE (FSCE), is based on differences in the electrophoretic mobility of the species, determined by the charge on the molecule, and the frictional resistance the molecule encounters during migration which is often directly proportional to the size of the molecule. Capillary isoelectric focusing (CIEF) allows weakly-ionizable amphoteric molecules, to be separated by electrophoresis in a pH gradient. CEC is a hybrid technique between traditional high performance liquid chromatography (HPLC) and CE.

Separation and purification techniques used in the present invention include any chromatography procedures known in the art. Chromatography can be based on the differential adsorption and elution of certain analytes or partitioning of analytes between mobile and stationary phases. Different examples of chromatography include, but not limited to, liquid chromatography (LC), gas chromatography (GC), high performance liquid chromatography (HPLC), etc.

IV. Biomarker Nucleic Acids and Polypeptides

One aspect of the present invention pertains to the use of isolated nucleic acid molecules that correspond to biomarker nucleic acids that encode a biomarker polypeptide or a portion of such a polypeptide. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

A biomarker nucleic acid molecule of the present invention can be isolated using standard molecular biology techniques and the sequence information in the database records described herein. Using all or a portion of such nucleic acid sequences, nucleic acid molecules of the present invention can be isolated using standard hybridization and cloning techniques (e.g., as described in Sambrook et al., ed., *Molecular Cloning: A Laboratory Manual,* 2nd ed., Cold Spring Harbor Laboratory Press, Cold Spring Harbor, N.Y., 1989).

A nucleic acid molecule of the present invention can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the present invention can be prepared by standard synthetic techniques, e.g., using an automated DNA synthesizer.

Moreover, a nucleic acid molecule of the present invention can comprise only a portion of a nucleic acid sequence, wherein the full length nucleic acid sequence comprises a marker of the present invention or which encodes a polypeptide corresponding to a marker of the present invention. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a biomarker nucleic acid sequence. Probes based on the sequence of a biomarker nucleic acid molecule can be used to detect transcripts or genomic sequences corresponding to one or more markers of the present invention. The probe comprises a label group attached thereto, e.g., a radioisotope, a fluorescent compound, an enzyme, or an enzyme co-factor.

A biomarker nucleic acid molecules that differ, due to degeneracy of the genetic code, from the nucleotide sequence of nucleic acid molecules encoding a protein which corresponds to the biomarker, and thus encode the same protein, are also contemplated.

In addition, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

The term "allele," which is used interchangeably herein with "allelic variant," refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene or allele. For example, biomarker alleles can differ from each other in a single nucleotide, or several nucleotides, and can include substitutions, deletions, and insertions of nucleotides. An allele of a gene can also be a form of a gene containing one or more mutations.

The term "allelic variant of a polymorphic region of gene" or "allelic variant", used interchangeably herein, refers to an alternative form of a gene having one of several possible nucleotide sequences found in that region of the gene in the population. As used herein, allelic variant is meant to encompass functional allelic variants, non-functional allelic variants, SNPs, mutations and polymorphisms.

The term "single nucleotide polymorphism" (SNP) refers to a polymorphic site occupied by a single nucleotide, which is the site of variation between allelic sequences. The site is usually preceded by and followed by highly conserved sequences of the allele (e.g., sequences that vary in less than 1/100 or 1/1000 members of a population). A SNP usually arises due to substitution of one nucleotide for another at the polymorphic site. SNPs can also arise from a deletion of a nucleotide or an insertion of a nucleotide relative to a reference allele. Typically the polymorphic site is occupied by a base other than the reference base. For example, where the reference allele contains the base "T" (thymidine) at the polymorphic site, the altered allele can contain a "C" (cytidine), "G" (guanine), or "A" (adenine) at the polymorphic site. SNP's may occur in protein-coding nucleic acid sequences, in which case they may give rise to a defective or otherwise variant protein, or genetic disease. Such a SNP may alter the coding sequence of the gene and therefore specify another amino acid (a "missense" SNP) or a SNP may introduce a stop codon (a "nonsense" SNP). When a SNP does not alter the amino acid sequence of a protein, the SNP is called "silent." SNP's may also occur in noncoding regions of the nucleotide sequence. This may result in defective protein expression, e.g., as a result of alternative spicing, or it may have no effect on the function of the protein.

As used herein, the terms "gene" and "recombinant gene" refer to nucleic acid molecules comprising an open reading frame encoding a polypeptide corresponding to a marker of the present invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the present invention.

In another embodiment, a biomarker nucleic acid molecule is at least 7, 15, 20, 25, 30, 40, 60, 80, 100, 150, 200, 250, 300, 350, 400, 450, 550, 650, 700, 800, 900, 1000, 1100, 1200, 1300, 1400, 1500, 1600, 1700, 1800, 1900, 2000, 2200, 2400, 2600, 2800, 3000, 3500, 4000, 4500, or more nucleotides in length and hybridizes under stringent conditions to a nucleic acid molecule corresponding to a marker of the present invention or to a nucleic acid molecule encoding a protein corresponding to a marker of the present invention. As used herein, the term "hybridizes under stringent conditions" is intended to describe conditions for hybridization and washing under which nucleotide sequences at least 60% (65%, 70%, 75%, 80%, preferably 85%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the present invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the present invention pertains to nucleic acid molecules encoding a polypeptide of the present invention that contain changes in amino acid residues that are not essential for activity. Such polypeptides differ in amino acid sequence from the naturally-occurring proteins which correspond to the markers of the present invention, yet retain biological activity. In one embodiment, a biomarker protein has an amino acid sequence that is at least about 40% identical, 50%, 60%, 70%, 75%, 80%, 83%, 85%, 87.5%, 90%, 91%, 92%, 93%, 94%, 95%, 96%, 97%, 98%, 99% or identical to the amino acid sequence of a biomarker protein described herein.

An isolated nucleic acid molecule encoding a variant protein can be created by introducing one or more nucleotide substitutions, additions or deletions into the nucleotide sequence of nucleic acids of the present invention, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

In some embodiments, the present invention further contemplates the use of anti-biomarker antisense nucleic acid molecules, i.e., molecules which are complementary to a sense nucleic acid of the present invention, e.g., complementary to the coding strand of a double-stranded cDNA molecule corresponding to a marker of the present invention or complementary to an mRNA sequence corresponding to a marker of the present invention. Accordingly, an antisense nucleic acid molecule of the present invention can hydrogen bond to (i.e. anneal with) a sense nucleic acid of the present invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the present invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been sub-cloned in an antisense orientation (i.e., RNA transcribed from the inserted nucleic acid will be of an antisense orientation to a target nucleic acid of interest, described further in the following subsection).

The antisense nucleic acid molecules of the present invention are typically administered to a subject or generated in situ such that they hybridize with or bind to cellular mRNA and/or genomic DNA encoding a polypeptide corresponding to a selected marker of the present invention to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the present invention includes direct injection at a tissue site or infusion of the antisense nucleic acid into a blood- or bone marrow-associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the present invention can be an α-anomeric nucleic acid molecule. An α-anomeric nucleic acid molecule forms specific double-stranded hybrids with complementary RNA in which, contrary to the usual α-units, the strands run parallel to each other (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The present invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach (1988) *Nature* 334:585-591) can be used to catalytically cleave mRNA transcripts to thereby inhibit translation of the protein encoded by the mRNA. A ribozyme having specificity for a nucleic acid molecule encoding a polypeptide corresponding to a marker of the present invention can be designed based upon the nucleotide sequence of a cDNA corresponding to the marker. For example, a derivative of a Tetrahymena L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the present invention can be used to select a catalytic RNA having a specific ribonuclease activity from a pool of RNA molecules (see, e.g., Bartel and Szostak (1993) *Science* 261:1411-1418).

The present invention also encompasses nucleic acid molecules which form triple helical structures. For example, expression of a biomarker protein can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660:27-36; and Maher (1992) *Bioassays* 14(12):807-15.

In various embodiments, the nucleic acid molecules of the present invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acid molecules (see Hyrup et al. (1996) *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup (1996), supra; Perry-O'Keefe et al. (1996) *Proc. Natl. Acad. Sci. USA* 93:14670-14675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup (1996), supra). The synthesis of PNA-DNA chimeras can be performed as described in Hyrup (1996), supra, and Finn et al. (1996) *Nucleic Acids Res.* 24(17):3357-3363. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al. (1989) *Nucleic Acids Res.* 17:5973-5988). PNA monomers are then coupled in a step-wise manner to produce a chimeric molecule with a 5' PNA segment and a 3' DNA segment (Finn et al. (1996) *Nucleic Acids Res.* 24:3357-3363). Alternatively, chimeric molecules can be synthesized with a 5' DNA segment and a 3' PNA segment (Peterser et al. (1975) *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al. (1988) *Bio/Techniques* 6:958-976) or intercalating agents (see, e.g., Zon (1988) *Pharm. Res.* 5:539-549). To this end, the oligonucleotide can be conjugated to another molecule, e.g., a peptide, hybridization triggered cross-linking agent, transport agent, hybridization-triggered cleavage agent, etc.

Another aspect of the present invention pertains to the use of biomarker proteins and biologically active portions thereof. In one embodiment, the native polypeptide corresponding to a marker can be isolated from cells or tissue sources by an appropriate purification scheme using standard protein purification techniques. In another embodiment, polypeptides corresponding to a marker of the present invention are produced by recombinant DNA techniques. Alternative to recombinant expression, a polypeptide corresponding to a marker of the present invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a biomarker polypeptide include polypeptides comprising amino acid sequences sufficiently identical to or derived from a biomarker protein amino acid sequence described herein, but which includes fewer amino acids than the full length protein, and exhibit at least one activity of the corresponding full-length protein. Typically, biologically active portions comprise a domain or motif with at least one activity of the corresponding protein. A biologically active portion of a protein of the present invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the present invention.

Preferred polypeptides have an amino acid sequence of a biomarker protein encoded by a nucleic acid molecule described herein. Other useful proteins are substantially identical (e.g., at least about 40%, preferably 50%, 60%, 70%, 75%, 80%, 83%, 85%, 88%, 90%, 91%, 92%, 93%, 94%, 95%, 96%, 97%, 98%, or 99%) to one of these sequences and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990)*J Mol. Biol.* 215:403-410. BLAST nucleotide searches can be performed with the NBLAST program, score=100, wordlength=12 to obtain nucleotide sequences homologous to a nucleic acid molecules of the present invention. BLAST protein searches can be performed with the XBLAST program, score=50, wordlength=3 to obtain amino acid sequences homologous to a protein molecules of the present invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another preferred, non-limiting example of a mathematical algorithm utilized for the comparison of sequences is the algorithm of Myers and Miller, (1988) *Comput Appl Biosci,* 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The present invention also provides chimeric or fusion proteins corresponding to a biomarker protein. As used herein, a "chimeric protein" or "fusion protein" comprises all or part (preferably a biologically active part) of a polypeptide corresponding to a marker of the present invention operably linked to a heterologous polypeptide (i.e., a polypeptide other than the polypeptide corresponding to the marker). Within the fusion protein, the term "operably linked" is intended to indicate that the polypeptide of the present invention and the heterologous polypeptide are fused in-frame to each other. The heterologous polypeptide can be fused to the amino-terminus or the carboxyl-terminus of the polypeptide of the present invention.

One useful fusion protein is a GST fusion protein in which a polypeptide corresponding to a marker of the present invention is fused to the carboxyl terminus of GST sequences. Such fusion proteins can facilitate the purification of a recombinant polypeptide of the present invention.

In another embodiment, the fusion protein contains a heterologous signal sequence, immunoglobulin fusion protein, toxin, or other useful protein sequence. Chimeric and fusion proteins of the present invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the present invention can be cloned into such an expression vector such that the fusion moiety is linked in-frame to the polypeptide of the present invention.

A signal sequence can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the present invention pertains to the described polypeptides having a signal sequence, as well as to polypeptides from which the signal sequence has been proteolytically cleaved (i.e., the cleavage products). In one embodiment, a nucleic acid sequence encoding a signal sequence can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the biomarker polypeptides described herein. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a biomarker protein which function as either agonists (mimetics) or as antagonists can be identified by screening combinatorial libraries of mutants, e.g., truncation mutants, of the protein of the present invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the polypeptides of the present invention from a degenerate oligonucleotide sequence. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477).

In addition, libraries of fragments of the coding sequence of a polypeptide corresponding to a marker of the present invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the present invention (Arkin and Yourvan (1992) *Proc. Natl. Acad. Sci. USA* 89:7811-7815; Delgrave et al. 91993) *Protein Engineering* 6(3):327-331).

The production and use of biomarker nucleic acid and/or biomarker polypeptide molecules described herein can be facilitated by using standard recombinant techniques. In some embodiments, such techniques use vectors, preferably expression vectors, containing a nucleic acid encoding a biomarker polypeptide or a portion of such a polypeptide. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, namely expression vectors, are capable of directing the expression of genes to which they are operably linked. In general, expression vectors of utility in recombinant DNA techniques are often in the form of plasmids (vectors). However, the present invention is intended to include such other forms of expression vectors, such as viral vectors (e.g., replication defective retroviruses, adenoviruses and adeno-associated viruses), which serve equivalent functions.

The recombinant expression vectors of the present invention comprise a nucleic acid of the present invention in a form suitable for expression of the nucleic acid in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Methods in Enzymology: Gene Expression Technology* vol. 185, Academic Press, San Diego, Calif. (1991). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the present invention can be introduced into host cells to thereby produce proteins or peptides, including fusion proteins or peptides, encoded by nucleic acids as described herein.

The recombinant expression vectors for use in the present invention can be designed for expression of a polypeptide corresponding to a marker of the present invention in prokaryotic (e.g., *E. coli*) or eukaryotic cells (e.g., insect cells {using baculovirus expression vectors}, yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al. (1988) *Gene* 69:301-315) and pET 11d (Studier et al., p. 60-89, In *Gene Expression Technology: Methods in Enzymology* vol. 185, Academic Press, San Diego, Calif., 1991). Target biomarker nucleic acid expression from the pTrc vector relies on host RNA polymerase transcription from a hybrid trp-lac fusion promoter. Target biomarker nucleic acid expression from the pET 11d vector relies on transcription from a T7 gn10-lac fusion promoter mediated by a co-expressed viral RNA polymerase (T7 gn1). This viral polymerase is supplied by host strains BL21 (DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacterium with an impaired capacity to proteolytically cleave the recombinant protein (Gottesman, p. 119-128, In *Gene Expression Technology: Methods in Enzymology* vol. 185, Academic Press, San Diego, Calif., 1990. Another strategy is to alter the nucleic acid sequence of the nucleic acid to be inserted into an expression vector so that the individual codons for each amino acid are those preferentially utilized in *E. coli* (Wada et al., (1992) *Nucleic Acids Res.* 20:2111-2118). Such alteration of nucleic acid sequences of the present invention can be carried out by standard DNA synthesis techniques.

In another embodiment, the expression vector is a yeast expression vector. Examples of vectors for expression in yeast *S. cerevisiae* include pYepSec1 (Baldari et al. (1987) *EMBO J.* 6:229-234), pMFa (Kurjan and Herskowitz (1982) *Cell* 30:933-943), pJRY88 (Schultz et al. (1987) *Gene* 54:113-123), pYES2 (Invitrogen Corporation, San Diego, Calif.), and pPicZ (Invitrogen Corp, San Diego, Calif.).

Alternatively, the expression vector is a baculovirus expression vector. Baculovirus vectors available for expression of proteins in cultured insect cells (e.g., Sf 9 cells)

include the pAc series (Smith et al. (1983) *Mol. Cell Biol.* 3:2156-2165) and the pVL series (Lucklow and Summers (1989) *Virology* 170:31-39).

In yet another embodiment, a nucleic acid of the present invention is expressed in mammalian cells using a mammalian expression vector. Examples of mammalian expression vectors include pCDM8 (Seed (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374-379) and the α-fetoprotein promoter (Camper and Tilghman (1989) *Genes Dev.* 3:537-546).

The present invention further provides a recombinant expression vector comprising a DNA molecule cloned into the expression vector in an antisense orientation. That is, the DNA molecule is operably linked to a regulatory sequence in a manner which allows for expression (by transcription of the DNA molecule) of an RNA molecule which is antisense to the mRNA encoding a polypeptide of the present invention. Regulatory sequences operably linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue-specific or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes (see Weintraub et al. (1986) *Trends in Genetics*, Vol. 1(1)).

Another aspect of the present invention pertains to host cells into which a recombinant expression vector of the present invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic (e.g., *E. coli*) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

V. Analyzing Biomarker Nucleic Acids and Polypeptides

Biomarker nucleic acids and/or biomarker polypeptides can be analyzed according to the methods described herein and techniques known to the skilled artisan to identify such genetic or expression alterations useful for the present invention including, but not limited to, 1) an alteration in the level of a biomarker transcript or polypeptide, 2) a deletion or addition of one or more nucleotides from a biomarker gene, 4) a substitution of one or more nucleotides of a biomarker gene, 5) aberrant modification of a biomarker gene, such as an expression regulatory region, and the like.

a. Methods for Detection of Copy Number

Methods of evaluating the copy number of a biomarker nucleic acid are well known to those of skill in the art. The presence or absence of chromosomal gain or loss can be evaluated simply by a determination of copy number of the regions or markers identified herein.

In one embodiment, a biological sample is tested for the presence of copy number changes in genomic loci containing the genomic marker. A copy number of at least 3, 4, 5, 6, 7, 8, 9, or 10 is predictive of poorer outcome of anti-immune checkpoint treatment.

Methods of evaluating the copy number of a biomarker locus include, but are not limited to, hybridization-based assays. Hybridization-based assays include, but are not limited to, traditional "direct probe" methods, such as Southern blots, in situ hybridization (e.g., FISH and FISH plus SKY) methods, and "comparative probe" methods, such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In one embodiment, evaluating the biomarker gene copy number in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid. Alternatively, a Northern blot may be utilized for evaluating the copy number of encoding nucleic acid in a sample. In a Northern blot, mRNA is hybridized to a probe specific for the target region. Comparison of the intensity of the hybridization signal from the probe for the target region with control probe signal from analysis of normal RNA (e.g., a non-amplified portion of the same or related cell, tissue, organ, etc.) provides an estimate of the relative copy number of the target nucleic acid. Alternatively, other methods well known in the art to detect RNA can be used, such that higher or lower expression relative to an appropriate control (e.g., a non-amplified portion of the same or related cell tissue, organ, etc.) provides an estimate of the relative copy number of the target nucleic acid.

An alternative means for determining genomic copy number is in situ hybridization (e.g., Angerer (1987) *Meth. Enzymol* 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application. In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained. The probes are typically labeled, e.g., with radioisotopes or fluorescent reporters. In one embodiment, probes are sufficiently long so as to specifically hybridize with the target nucleic acid(s) under stringent conditions. Probes generally range in length from about 200 bases to about 1000 bases. In some applications it is necessary to block the hybridization capacity of repetitive sequences. Thus, in some embodiments, tRNA, human genomic DNA, or Cot-I DNA is used to block non-specific hybridization.

An alternative means for determining genomic copy number is comparative genomic hybridization. In general, genomic DNA is isolated from normal reference cells, as well as from test cells (e.g., tumor cells) and amplified, if necessary. The two nucleic acids are differentially labeled and then hybridized in situ to metaphase chromosomes of a reference cell. The repetitive sequences in both the reference and test DNAs are either removed or their hybridization capacity is reduced by some means, for example by prehybridization with appropriate blocking nucleic acids and/or including such blocking nucleic acid sequences for said repetitive sequences during said hybridization. The bound, labeled DNA sequences are then rendered in a visualizable form, if necessary. Chromosomal regions in the test cells which are at increased or decreased copy number can be identified by detecting regions where the ratio of signal from the two DNAs is altered. For example, those regions that have decreased in copy number in the test cells will show relatively lower signal from the test DNA than the reference compared to other regions of the genome. Regions that have been increased in copy number in the test cells will show relatively higher signal from the test DNA. Where there are chromosomal deletions or multiplications, differences in the ratio of the signals from the two labels will be detected and the ratio will provide a measure of the copy number. In another embodiment of CGH, array CGH (aCGH), the immobilized chromosome element is replaced with a collection of solid support bound target nucleic acids on an array, allowing for a large or complete percentage of the genome to be represented in the collection of solid support bound targets. Target nucleic acids may comprise cDNAs, genomic DNAs, oligonucleotides (e.g., to detect single nucleotide polymorphisms) and the like. Array-based CGH may also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Methods of preparing immobilized chromosomes or arrays and performing comparative genomic hybridization are well known in the art (see, e.g., U.S. Pat. Nos. 6,335,167; 6,197,501; 5,830,645; and 5,665,549 and Albertson (1984) *EMBO J.* 3: 1227-1234; Pinkel (1988) *Proc. Natl. Acad. Sci. USA* 85: 9138-9142; EPO Pub. No. 430,402; *Methods in Molecular Biology*, Vol. 33: In situ Hybridization Protocols, Choo, ed., Humana Press, Totowa, N.J. (1994), etc.). In another embodiment, the hybridization protocol of Pinkel, et al. (1998) *Nature Genetics* 20: 207-211, or of Kallioniemi (1992) *Proc. Natl Acad Sci USA* 89:5321-5325 (1992) is used.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis, et al. (1990) PCR Protocols, *A Guide to Methods and Applications*, Academic Press, Inc. N.Y.). Measurement of DNA copy number at microsatellite loci using quantitative PCR analysis is described in Ginzonger, et al. (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods of the present invention. In fluorogenic quantitative PCR, quantitation is based on amount of fluorescence signals, e.g., TaqMan and SYBR green.

Other suitable amplification methods include, but are not limited to, ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc.

Loss of heterozygosity (LOH) and major copy proportion (MCP) mapping (Wang, Z. C., et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93; Li et al., (2008)*MBC Bioinform.* 9, 204-219) may also be used to identify regions of amplification or deletion.

b. Methods for Detection of Biomarker Nucleic Acid Expression

Biomarker expression may be assessed by any of a wide variety of well known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

In another embodiment, detecting or determining expression levels of a biomarker and functionally similar homologs thereof, including a fragment or genetic alteration thereof (e.g., in regulatory or promoter regions thereof) comprises detecting or determining RNA levels for the marker of interest. In one embodiment, one or more cells from the subject to be tested are obtained and RNA is isolated from the cells. In a preferred embodiment, a sample of breast tissue cells is obtained from the subject.

In one embodiment, RNA is obtained from a single cell. For example, a cell can be isolated from a tissue sample by laser capture microdissection (LCM). Using this technique, a cell can be isolated from a tissue section, including a stained tissue section, thereby assuring that the desired cell is isolated (see, e.g., Bonner et al. (1997) *Science* 278:1481; Emmert-Buck et al. (1996) *Science* 274:998; Fend et al. (1999)*Am. J. Path.* 154:61 and Murakami et al. (2000) *Kidney Int.* 58:1346). For example, Murakami et al., supra, describe isolation of a cell from a previously immunostained tissue section.

It is also possible to obtain cells from a subject and culture the cells in vitro, such as to obtain a larger population of cells from which RNA can be extracted. Methods for establishing cultures of non-transformed cells, i.e., primary cell cultures, are known in the art.

When isolating RNA from tissue samples or cells from individuals, it may be important to prevent any further changes in gene expression after the tissue or cells has been removed from the subject. Changes in expression levels are known to change rapidly following perturbations, e.g., heat shock or activation with lipopolysaccharide (LPS) or other reagents. In addition, the RNA in the tissue and cells may quickly become degraded. Accordingly, in a preferred embodiment, the tissue or cells obtained from a subject is snap frozen as soon as possible.

RNA can be extracted from the tissue sample by a variety of methods, e.g., the guanidium thiocyanate lysis followed by CsCl centrifugation (Chirgwin et al. (1979) *Biochemistry* 18:5294-5299). RNA from single cells can be obtained as described in methods for preparing cDNA libraries from single cells, such as those described in Dulac, C. (1998) *Curr. Top. Dev. Biol.* 36:245 and Jena et al. (1996) *J Immunol. Methods* 190:199. Care to avoid RNA degradation must be taken, e.g., by inclusion of RNAsin.

The RNA sample can then be enriched in particular species. In one embodiment, poly(A)+RNA is isolated from the RNA sample. In general, such purification takes advantage of the poly-A tails on mRNA. In particular and as noted above, poly-T oligonucleotides may be immobilized within on a solid support to serve as affinity ligands for mRNA. Kits for this purpose are commercially available, e.g., the MessageMaker kit (Life Technologies, Grand Island, N.Y.).

In a preferred embodiment, the RNA population is enriched in marker sequences. Enrichment can be undertaken, e.g., by primer-specific cDNA synthesis, or multiple rounds of linear amplification based on cDNA synthesis and template-directed in vitro transcription (see, e.g., Wang et al. (1989) PNAS 86, 9717; Dulac et al., supra, and Jena et al., supra).

The population of RNA, enriched or not in particular species or sequences, can further be amplified. As defined herein, an "amplification process" is designed to strengthen, increase, or augment a molecule within the RNA. For example, where RNA is mRNA, an amplification process such as RT-PCR can be utilized to amplify the mRNA, such that a signal is detectable or detection is enhanced. Such an amplification process is beneficial particularly when the biological, tissue, or tumor sample is of a small size or volume.

Various amplification and detection methods can be used. For example, it is within the scope of the present invention to reverse transcribe mRNA into cDNA followed by polymerase chain reaction (RT-PCR); or, to use a single enzyme for both steps as described in U.S. Pat. No. 5,322,770, or reverse transcribe mRNA into cDNA followed by symmetric gap ligase chain reaction (RT-AGLCR) as described by R. L. Marshall, et al., *PCR Methods and Applications* 4: 80-84 (1994). Real time PCR may also be used.

Other known amplification methods which can be utilized herein include but are not limited to the so-called "NASBA" or "3SR" technique described in *PNAS* USA 87: 1874-1878 (1990) and also described in Nature 350 (No. 6313): 91-92 (1991); Q-beta amplification as described in published European Patent Application (EPA) No. 4544610; strand displacement amplification (as described in G. T. Walker et al., *Clin. Chem.* 42: 9-13 (1996) and European Patent Application No. 684315; target mediated amplification, as described by PCT Publication WO9322461; PCR; ligase chain reaction (LCR) (see, e.g., Wu and Wallace, Genomics 4, 560 (1989), Landegren et al., *Science* 241, 1077 (1988)); self-sustained sequence replication (SSR) (see, e.g., Guatelli et al., *Proc. Nat. Acad. Sci. USA,* 87, 1874 (1990)); and transcription amplification (see, e.g., Kwoh et al., *Proc. Natl. Acad. Sci. USA* 86, 1173 (1989)).

Many techniques are known in the state of the art for determining absolute and relative levels of gene expression, commonly used techniques suitable for use in the present invention include Northern analysis, RNase protection assays (RPA), microarrays and PCR-based techniques, such as quantitative PCR and differential display PCR. For example, Northern blotting involves running a preparation of RNA on a denaturing agarose gel, and transferring it to a suitable support, such as activated cellulose, nitrocellulose or glass or nylon membranes. Radiolabeled cDNA or RNA is then hybridized to the preparation, washed and analyzed by autoradiography.

In situ hybridization visualization may also be employed, wherein a radioactively labeled antisense RNA probe is hybridized with a thin section of a biopsy sample, washed, cleaved with RNase and exposed to a sensitive emulsion for autoradiography. The samples may be stained with hematoxylin to demonstrate the histological composition of the sample, and dark field imaging with a suitable light filter shows the developed emulsion. Non-radioactive labels such as digoxigenin may also be used.

Alternatively, mRNA expression can be detected on a DNA array, chip or a microarray. Labeled nucleic acids of a test sample obtained from a subject may be hybridized to a solid surface comprising biomarker DNA. Positive hybridization signal is obtained with the sample containing biomarker transcripts. Methods of preparing DNA arrays and their use are well known in the art (see, e.g., U.S. Pat. Nos: 6,618,6796; 6,379,897; 6,664,377; 6,451,536; 548,257; U.S. 20030157485 and Schena et al. (1995) *Science* 20, 467-470; Gerhold et al. (1999) *Trends In Biochem. Sci.* 24, 168-173; and Lennon et al. (2000) *Drug Discovery Today* 5, 59-65, which are herein incorporated by reference in their entirety). Serial Analysis of Gene Expression (SAGE) can also be performed (See for example U.S. Patent Application 20030215858).

To monitor mRNA levels, for example, mRNA is extracted from the biological sample to be tested, reverse transcribed, and fluorescently-labeled cDNA probes are generated. The microarrays capable of hybridizing to marker cDNA are then probed with the labeled cDNA probes, the slides scanned and fluorescence intensity measured. This intensity correlates with the hybridization intensity and expression levels.

Types of probes that can be used in the methods described herein include cDNA, riboprobes, synthetic oligonucleotides and genomic probes. The type of probe used will generally be dictated by the particular situation, such as riboprobes for in situ hybridization, and cDNA for Northern blotting, for example. In one embodiment, the probe is directed to nucleotide regions unique to the RNA. The probes may be as short as is required to differentially recognize marker mRNA transcripts, and may be as short as, for example, 15 bases; however, probes of at least 17, 18, 19 or 20 or more bases can be used. In one embodiment, the primers and probes hybridize specifically under stringent conditions to a DNA fragment having the nucleotide sequence corresponding to the marker. As herein used, the term "stringent conditions" means hybridization will occur only if there is at least 95% identity in nucleotide sequences. In another embodiment, hybridization under "stringent conditions" occurs when there is at least 97% identity between the sequences.

The form of labeling of the probes may be any that is appropriate, such as the use of radioisotopes, for example, $^{32}$P and $^{35}$S. Labeling with radioisotopes may be achieved, whether the probe is synthesized chemically or biologically, by the use of suitably labeled bases.

In one embodiment, the biological sample contains polypeptide molecules from the test subject. Alternatively, the biological sample can contain mRNA molecules from the test subject or genomic DNA molecules from the test subject.

In another embodiment, the methods further involve obtaining a control biological sample from a control subject, contacting the control sample with a compound or agent capable of detecting marker polypeptide, mRNA, genomic DNA, or fragments thereof, such that the presence of the marker polypeptide, mRNA, genomic DNA, or fragments thereof, is detected in the biological sample, and comparing the presence of the marker polypeptide, mRNA, genomic DNA, or fragments thereof, in the control sample with the presence of the marker polypeptide, mRNA, genomic DNA, or fragments thereof in the test sample.

c. Methods for Detection of Biomarker Protein Expression

The activity or level of a biomarker protein can be detected and/or quantified by detecting or quantifying the expressed polypeptide. The polypeptide can be detected and quantified by any of a number of means well known to those of skill in the art. Aberrant levels of polypeptide expression of the polypeptides encoded by a biomarker nucleic acid and functionally similar homologs thereof, including a fragment or genetic alteration thereof (e.g., in regulatory or promoter regions thereof) are associated with the likelihood of response of a cancer to an immune checkpoint therapy. Any method known in the art for detecting polypeptides can be used. Such methods include, but are not limited to, immunodiffusion, immunoelectrophoresis, radioimmunoassay (MA), enzyme-linked immunosorbent assays (ELISAs), immunofluorescent assays, Western blotting, binder-ligand assays, immunohistochemical techniques, agglutination, complement assays, high performance liquid chromatography (HPLC), thin layer chromatography (TLC), hyperdiffusion chromatography, and the like (e.g., Basic and Clinical Immunology, Sites and Terr, eds., Appleton and Lange, Norwalk, Conn. pp 217-262, 1991 which is incorporated by reference). Preferred are binder-ligand immunoassay methods including reacting antibodies with an epitope or epitopes and competitively displacing a labeled polypeptide or derivative thereof.

For example, ELISA and MA procedures may be conducted such that a desired biomarker protein standard is labeled (with a radioisotope such as $^{125}$I or $^{35}$S, or an assayable enzyme, such as horseradish peroxidase or alkaline phosphatase), and, together with the unlabelled sample, brought into contact with the corresponding antibody, whereon a second antibody is used to bind the first, and radioactivity or the immobilized enzyme assayed (competitive assay). Alternatively, the biomarker protein in the sample is allowed to react with the corresponding immobilized antibody, radioisotope- or enzyme-labeled anti-biomarker proteinantibody is allowed to react with the system, and radioactivity or the enzyme assayed (ELISA-sandwich assay). Other conventional methods may also be employed as suitable.

The above techniques may be conducted essentially as a "one-step" or "two-step" assay. A "one-step" assay involves contacting antigen with immobilized antibody and, without washing, contacting the mixture with labeled antibody. A "two-step" assay involves washing before contacting, the mixture with labeled antibody. Other conventional methods may also be employed as suitable.

In one embodiment, a method for measuring biomarker protein levels comprises the steps of: contacting a biological specimen with an antibody or variant (e.g., fragment) thereof which selectively binds the biomarker protein, and detecting whether said antibody or variant thereof is bound to said sample and thereby measuring the levels of the biomarker protein.

Enzymatic and radiolabeling of biomarker protein and/or the antibodies may be effected by conventional means. Such means will generally include covalent linking of the enzyme to the antigen or the antibody in question, such as by glutaraldehyde, specifically so as not to adversely affect the activity of the enzyme, by which is meant that the enzyme must still be capable of interacting with its substrate, although it is not necessary for all of the enzyme to be active, provided that enough remains active to permit the assay to be effected. Indeed, some techniques for binding enzyme are non-specific (such as using formaldehyde), and will only yield a proportion of active enzyme.

It is usually desirable to immobilize one component of the assay system on a support, thereby allowing other components of the system to be brought into contact with the component and readily removed without laborious and time-consuming labor. It is possible for a second phase to be immobilized away from the first, but one phase is usually sufficient.

It is possible to immobilize the enzyme itself on a support, but if solid-phase enzyme is required, then this is generally best achieved by binding to antibody and affixing the antibody to a support, models and systems for which are well-known in the art. Simple polyethylene may provide a suitable support.

Enzymes employable for labeling are not particularly limited, but may be selected from the members of the oxidase group, for example. These catalyze production of hydrogen peroxide by reaction with their substrates, and glucose oxidase is often used for its good stability, ease of availability and cheapness, as well as the ready availability of its substrate (glucose). Activity of the oxidase may be assayed by measuring the concentration of hydrogen peroxide formed after reaction of the enzyme-labeled antibody with the substrate under controlled conditions well-known in the art.

Other techniques may be used to detect biomarker protein according to a practitioner's preference based upon the present disclosure. One such technique is Western blotting (Towbin et at., Proc. Nat. Acad. Sci. 76:4350 (1979)), wherein a suitably treated sample is run on an SDS-PAGE gel before being transferred to a solid support, such as a nitrocellulose filter. Anti-biomarker protein antibodies (un-labeled) are then brought into contact with the support and assayed by a secondary immunological reagent, such as labeled protein A or anti-immunoglobulin (suitable labels including $^{125}$I, horseradish peroxidase and alkaline phosphatase). Chromatographic detection may also be used.

Immunohistochemistry may be used to detect expression of biomarker protein, e.g., in a biopsy sample. A suitable antibody is brought into contact with, for example, a thin layer of cells, washed, and then contacted with a second, labeled antibody. Labeling may be by fluorescent markers, enzymes, such as peroxidase, avidin, or radiolabelling. The assay is scored visually, using microscopy.

Anti-biomarker protein antibodies, such as intrabodies, may also be used for imaging purposes, for example, to detect the presence of biomarker protein in cells and tissues of a subject. Suitable labels include radioisotopes, iodine ($^{125}$I, $^{121}$I) carbon ($^{14}$C), sulphur ($^{35}$S), tritium ($^{3}$H), indium ($^{112}$In), and technetium ($^{99}$mTc), fluorescent labels, such as fluorescein and rhodamine, and biotin.

For in vivo imaging purposes, antibodies are not detectable, as such, from outside the body, and so must be labeled, or otherwise modified, to permit detection. Markers for this purpose may be any that do not substantially interfere with the antibody binding, but which allow external detection. Suitable markers may include those that may be detected by X-radiography, NMR or MM. For X-radiographic techniques, suitable markers include any radioisotope that emits detectable radiation but that is not overtly harmful to the subject, such as barium or cesium, for example. Suitable markers for NMR and MM generally include those with a detectable characteristic spin, such as deuterium, which may be incorporated into the antibody by suitable labeling of nutrients for the relevant hybridoma, for example.

The size of the subject, and the imaging system used, will determine the quantity of imaging moiety needed to produce diagnostic images. In the case of a radioisotope moiety, for a human subject, the quantity of radioactivity injected will normally range from about 5 to 20 millicuries of technetium-99. The labeled antibody or antibody fragment will then preferentially accumulate at the location of cells which contain biomarker protein. The labeled antibody or antibody fragment can then be detected using known techniques.

Antibodies that may be used to detect biomarker protein include any antibody, whether natural or synthetic, full length or a fragment thereof, monoclonal or polyclonal, that binds sufficiently strongly and specifically to the biomarker protein to be detected. An antibody may have a $K_d$ of at most about $10^{-6}$M, $10^{-7}$M, $10^{-8}$M, $10^{-9}$M, $10^{-10}$ M, $10^{-11}$ M, $10^{-12}$M. The phrase "specifically binds" refers to binding of, for example, an antibody to an epitope or antigen or antigenic determinant in such a manner that binding can be displaced or competed with a second preparation of identical or similar epitope, antigen or antigenic determinant. An antibody may bind preferentially to the biomarker protein relative to other proteins, such as related proteins.

Antibodies are commercially available or may be prepared according to methods known in the art.

Antibodies and derivatives thereof that may be used encompass polyclonal or monoclonal antibodies, chimeric, human, humanized, primatized (CDR-grafted), veneered or single-chain antibodies as well as functional fragments, i.e., biomarker protein binding fragments, of antibodies. For example, antibody fragments capable of binding to a biomarker protein or portions thereof, including, but not limited to, Fv, Fab, Fab' and F(ab') 2 fragments can be used. Such fragments can be produced by enzymatic cleavage or by recombinant techniques. For example, papain or pepsin cleavage can generate Fab or F(ab') 2 fragments, respectively. Other proteases with the requisite substrate specificity can also be used to generate Fab or F(ab') 2 fragments. Antibodies can also be produced in a variety of truncated forms using antibody genes in which one or more stop codons have been introduced upstream of the natural stop site. For example, a chimeric gene encoding a F(ab') 2 heavy chain portion can be designed to include DNA sequences encoding the CH, domain and hinge region of the heavy chain.

Synthetic and engineered antibodies are described in, e.g., Cabilly et al., U.S. Pat. No. 4,816,567 Cabilly et al., European Patent No. 0,125,023 B1; Boss et al., U.S. Pat. No. 4,816,397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Queen et al., European Patent No. 0451216 B1; and Padlan, E. A. et al., EP 0519596 A1. See also, Newman, R. et al., BioTechnology, 10: 1455-1460 (1992), regarding primatized antibody, and Ladner et al., U.S. Pat. No. 4,946,778 and Bird, R. E. et al., Science, 242: 423-426 (1988)) regarding single-chain antibodies. Antibodies produced from a library, e.g., phage display library, may also be used.

In some embodiments, agents that specifically bind to a biomarker protein other than antibodies are used, such as peptides. Peptides that specifically bind to a biomarker protein can be identified by any means known in the art. For example, specific peptide binders of a biomarker protein can be screened for using peptide phage display libraries.

d. Methods for Detection of Biomarker Structural Alterations

The following illustrative methods can be used to identify the presence of a structural alteration in a biomarker nucleic acid and/or biomarker polypeptide molecule in order to, for example, identify PBRM1 (or ARID2, BRD7, PHF10, KDM6A, ARID1A, ARID1B, BRG1, BRM, CRB1, EGFR, and the like) proteins that having mutations such as described herein.

In certain embodiments, detection of the alteration involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) Science 241:1077-1080; and Nakazawa et al. (1994) Proc. Natl. Acad. Sci. USA 91:360-364), the latter of which can be particularly useful for detecting point mutations in a biomarker nucleic acid such as a biomarker gene (see Abravaya et al. (1995) Nucleic Acids Res. 23:675-682). This method can include the steps of collecting a sample of cells from a subject, isolating nucleic acid (e.g., genomic, mRNA or both) from the cells of the sample, contacting the nucleic acid sample with one or more primers which specifically hybridize to a biomarker gene under conditions such that hybridization and amplification of the biomarker gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al. (1990) *Proc. Natl. Acad. Sci. USA* 87:1874-1878), transcriptional amplification system (Kwoh, D. Y. et al. (1989) *Proc. Natl. Acad. Sci. USA* 86:1173-1177), Q-Beta Replicase (Lizardi, P. M. et al. (1988) *Bio-Technology* 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a biomarker nucleic acid from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in biomarker nucleic acid can be identified by hybridizing a sample and control nucleic acids, e.g., DNA or RNA, to high density arrays containing hundreds or thousands of oligonucleotide probes (Cronin, M. T. et al. (1996) *Hum. Mutat.* 7:244-255; Kozal, M. J. et al. (1996) *Nat. Med.* 2:753-759). For example, biomarker genetic mutations can be identified in two dimensional arrays containing light-generated DNA probes as described in Cronin et al. (1996) supra. Briefly, a first hybridization array of probes can be used to scan through long stretches of DNA in a sample and control to identify base changes between the sequences by making linear arrays of sequential, overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene. Such biomarker genetic mutations can be identified in a variety of contexts, including, for example, germline and somatic mutations.

In yet another embodiment, any of a variety of sequencing reactions known in the art can be used to directly sequence a biomarker gene and detect mutations by comparing the sequence of the sample biomarker with the corresponding wild-type (control) sequence. Examples of sequencing reactions include those based on techniques developed by Maxam and Gilbert (1977) *Proc. Natl. Acad. Sci. USA* 74:560 or Sanger (1977) *Proc. Natl. Acad Sci. USA* 74:5463. It is also contemplated that any of a variety of automated sequencing procedures can be utilized when performing the diagnostic assays (Naeve (1995) *Biotechniques* 19:448-53), including sequencing by mass spectrometry (see, e.g., PCT International Publication No. WO 94/16101; Cohen et al. (1996) *Adv. Chromatogr.* 36:127-162; and Griffin et al. (1993) *Appl. Biochem. Biotechnol.* 38:147-159).

Other methods for detecting mutations in a biomarker gene include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes formed by hybridizing (labeled) RNA or DNA containing the wild-type biomarker sequence with potentially mutant RNA or DNA obtained from a tissue sample. The double-stranded duplexes are treated with an agent which cleaves single-stranded regions of the duplex such as which will exist due to base pair mismatches between the control and sample strands. For instance, RNA/DNA duplexes can be treated with RNase and DNA/DNA hybrids treated with SI nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl. Acad. Sci. USA* 85:4397 and Saleeba et al. (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in biomarker cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a biomarker sequence, e.g., a wild-type biomarker treated with a DNA mismatch repair enzyme, and the cleavage products, if any, can be detected from electrophoresis protocols or the like (e.g., U.S. Pat. No. 5,459,039.)

In other embodiments, alterations in electrophoretic mobility can be used to identify mutations in biomarker genes. For example, single strand conformation polymorphism (SSCP) may be used to detect differences in electrophoretic mobility between mutant and wild type nucleic acids (Orita et al. (1989) *Proc Natl. Acad. Sci USA* 86:2766; see also Cotton (1993) *Mutat. Res.* 285:125-144 and Hayashi (1992) *Genet. Anal. Tech. Appl.* 9:73-79). Single-stranded DNA fragments of sample and control biomarker nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to ensure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys. Chem.* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163; Saiki et al. (1989) *Proc. Natl. Acad. Sci. USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6:1). It is anticipated that in certain embodiments amplification may also be performed using Taq ligase for amplification (Barany (1991) *Proc. Natl. Acad. Sci USA* 88:189). In such cases, ligation will occur only if there is a perfect match at the 3' end of the 5' sequence making it possible to detect the presence of a known mutation at a specific site by looking for the presence or absence of amplification.

3. Anti-Cancer Therapies

The efficacy of immune checkpoint therapy is predicted according to biomarker amount and/or activity associated with a cancer in a subject according to the methods described herein. In one embodiment, such immune checkpoint therapy or combinations of therapies (e.g., anti-PD-1 antibodies) can be administered once a subject is indicated as being a likely responder to immune checkpoint therapy. In another embodiment, such immune checkpoint therapy can be avoided once a subject is indicated as not being a likely responder to immune checkpoint therapy and an alternative treatment regimen, such as targeted and/or untargeted anti-cancer therapies can be administered. Combination therapies are also contemplated and can comprise, for example, one or more chemotherapeutic agents and radiation, one or more chemotherapeutic agents and immunotherapy, or one or more chemotherapeutic agents, radiation and chemotherapy, each combination of which can be with immune checkpoint therapy.

The term "targeted therapy" refers to administration of agents that selectively interact with a chosen biomolecule to thereby treat cancer. For example, anti-PBRM1 agents (or anti-ARID2 agents, anti-BRD7 agents, anti-PHF10 agents, anti-KDM6A agents, etc.), such as therapeutic monoclonal blocking antibodies, which are well-known in the art and described above, can be used to target tumor microenvironments and cells expressing unwanted PBRM1 (or ARID2, BRD7, PHF10, KDM6A, ARID1A, ARID1B, BRG1, BRM, CRB1, EGFR, and the like). Similarly, nivolumab (Opdivo®) is a human IgG4 anti-PD-1 monoclonal antibody that blocks PD-1 activity (see, for example, Wang et al. (2014) *Cancer Immunol.* Res. 2:846-856; Johnson et al. (2015) *Ther. Adv. Med. Oncol.* 7:97-106; and Sundar et al. (2015) *Ther. Adv. Med. Oncol.* 7:85-96).

Immunotherapy is one form of targeted therapy that may comprise, for example, the use of cancer vaccines and/or sensitized antigen presenting cells. For example, an oncolytic virus is a virus that is able to infect and lyse cancer cells, while leaving normal cells unharmed, making them potentially useful in cancer therapy. Replication of oncolytic viruses both facilitates tumor cell destruction and also produces dose amplification at the tumor site. They may also act as vectors for anticancer genes, allowing them to be specifically delivered to the tumor site. The immunotherapy can involve passive immunity for short-term protection of a host, achieved by the administration of pre-formed antibody directed against a cancer antigen or disease antigen (e.g., administration of a monoclonal antibody, optionally linked to a chemotherapeutic agent or toxin, to a tumor antigen). Immunotherapy can also focus on using the cytotoxic lymphocyte-recognized epitopes of cancer cell lines. Alternatively, antisense polynucleotides, ribozymes, RNA interference molecules, triple helix polynucleotides and the like, can be used to selectively modulate biomolecules that are linked to the initiation, progression, and/or pathology of a tumor or cancer.

The term "untargeted therapy" referes to administration of agents that do not selectively interact with a chosen biomolecule yet treat cancer. ReRepresentative examples of untargeted therapies include, without limitation, chemotherapy, gene therapy, and radiation therapy.

In one embodiment, chemotherapy is used. Chemotherapy includes the administration of a chemotherapeutic agent. Such a chemotherapeutic agent may be, but is not limited to, those selected from among the following groups of compounds: platinum compounds, cytotoxic antibiotics, antimetabolities, anti-mitotic agents, alkylating agents, arsenic compounds, DNA topoisomerase inhibitors, taxanes, nucleoside analogues, plant alkaloids, and toxins; and synthetic derivatives thereof. Exemplary compounds include, but are not limited to, alkylating agents: cisplatin, treosulfan, and trofosfamide; plant alkaloids: vinblastine, paclitaxel, docetaxol; DNA topoisomerase inhibitors: teniposide, crisnatol, and mitomycin; anti-folates: methotrexate, mycophenolic acid, and hydroxyurea; pyrimidine analogs: 5-fluorouracil, doxifluridine, and cytosine arabinoside; purine analogs: mercaptopurine and thioguanine; DNA antimetabolites: 2'-deoxy-5-fluorouridine, aphidicolin glycinate, and pyrazoloimidazole; and antimitotic agents: halichondrin, colchicine, and rhizoxin. Compositions comprising one or more chemotherapeutic agents (e.g., FLAG, CHOP) may also be used. FLAG comprises fludarabine, cytosine arabinoside (Ara-C) and G-CSF. CHOP comprises cyclophosphamide, vincristine, doxorubicin, and prednisone. In another embodiments, PARP (e.g., PARP-1 and/or PARP-2) inhibitors are used and such inhibitors are well known in the art (e.g., Olaparib, ABT-888, BSI-201, BGP-15 (N-Gene Research Laboratories, Inc.); INO-1001 (Inotek Pharmaceuticals Inc.); PJ34 (Soriano et al., 2001; Pacher et al., 2002b); 3-aminobenzamide (Trevigen); 4-amino-1, 8-naphthalimide; (Trevigen); 6(5H)-phenanthridinone (Trevigen); benzamide (U.S. Pat. Re. 36,397); and NU1025 (Bowman et al.). The mechanism of action is generally related to the ability of PARP inhibitors to bind PARP and decrease its activity. PARP catalyzes the conversion of .beta.-nicotinamide adenine dinucleotide (NAD+) into nicotinamide and poly-ADP-ribose (PAR). Both poly (ADP-ribose) and PARP have been linked to regulation of transcription, cell proliferation, genomic stability, and carcinogenesis (Bouchard V. J. et. al. Experimental Hematology, Volume 31, Number 6, June 2003, pp. 446-454(9); Herceg Z.; Wang Z.-Q. Mutation Research/Fundamental and Molecular Mechanisms of Mutagenesis, Volume 477, Number 1, 2 Jun. 2001, pp. 97-110(14)). Poly(ADP-ribose) polymerase 1 (PARP1) is a key molecule in the repair of DNA single-strand breaks (SSBs) (de Murcia J. et al. 1997. Proc Natl Acad Sci USA 94:7303-7307; Schreiber V, Dantzer F, Ame J C, de Murcia G (2006) Nat Rev Mol Cell Biol 7:517-528; Wang Z Q, et al. (1997) Genes Dev 11:2347-2358). Knockout of SSB repair by inhibition of PARP1 function induces DNA double-strand breaks (DSBs) that can trigger synthetic lethality in cancer cells with defective homology-directed DSB repair (Bryant H E, et al. (2005) Nature 434:913-917; Farmer H, et al. (2005) Nature 434:917-921). The foregoing examples of chemotherapeutic agents are illustrative, and are not intended to be limiting.

In another embodiment, radiation therapy is used. The radiation used in radiation therapy can be ionizing radiation. Radiation therapy can also be gamma rays, X-rays, or proton beams. Examples of radiation therapy include, but are not limited to, external-beam radiation therapy, interstitial implantation of radioisotopes (I-125, palladium, iridium), radioisotopes such as strontium-89, thoracic radiation therapy, intraperitoneal P-32 radiation therapy, and/or total abdominal and pelvic radiation therapy. For a general overview of radiation therapy, see Hellman, Chapter 16: Principles of Cancer Management: Radiation Therapy, 6th edition, 2001, DeVita et al., eds., J. B. Lippencott Company, Philadelphia. The radiation therapy can be administered as external beam radiation or teletherapy wherein the radiation is directed from a remote source. The radiation treatment can also be administered as internal therapy or brachytherapy wherein a radioactive source is placed inside the body close to cancer cells or a tumor mass. Also encompassed is the use of photodynamic therapy comprising the administration of photosensitizers, such as hematoporphyrin and its derivatives, Vertoporfin (BPD-MA), phthalocyanine, photosensitizer Pc4, demethoxy-hypocrellin A; and 2BA-2-DMHA.

In another embodiment, hormone therapy is used. Hormonal therapeutic treatments can comprise, for example, hormonal agonists, hormonal antagonists (e.g., flutamide, bicalutamide, tamoxifen, raloxifene, leuprolide acetate (LUPRON), LH-RH antagonists), inhibitors of hormone biosynthesis and processing, and steroids (e.g., dexamethasone, retinoids, deltoids, betamethasone, cortisol, cortisone, prednisone, dehydrotestosterone, glucocorticoids, mineralocorticoids, estrogen, testosterone, progestins), vitamin A derivatives (e.g., all-trans retinoic acid (ATRA)); vitamin D3 analogs; antigestagens (e.g., mifepristone, onapristone), or antiandrogens (e.g., cyproterone acetate).

In another embodiment, hyperthermia, a procedure in which body tissue is exposed to high temperatures (up to 106° F.) is used. Heat may help shrink tumors by damaging cells or depriving them of substances they need to live. Hyperthermia therapy can be local, regional, and whole-body hyperthermia, using external and internal heating devices. Hyperthermia is almost always used with other forms of therapy (e.g., radiation therapy, chemotherapy, and biological therapy) to try to increase their effectiveness. Local hyperthermia refers to heat that is applied to a very small area, such as a tumor. The area may be heated externally with high-frequency waves aimed at a tumor from a device outside the body. To achieve internal heating, one of several types of sterile probes may be used, including thin, heated wires or hollow tubes filled with warm water; implanted microwave antennae; and radiofrequency electrodes. In regional hyperthermia, an organ or a limb is heated. Magnets and devices that produce high energy are placed over the region to be heated. In another approach, called perfusion, some of the patient's blood is removed, heated, and then pumped (perfused) into the region that is to be heated internally. Whole-body heating is used to treat metastatic cancer that has spread throughout the body. It can be accomplished using warm-water blankets, hot wax, inductive coils (like those in electric blankets), or thermal chambers (similar to large incubators). Hyperthermia does not cause any marked increase in radiation side effects or complications. Heat applied directly to the skin, however, can cause discomfort or even significant local pain in about half the patients treated. It can also cause blisters, which generally heal rapidly.

In still another embodiment, photodynamic therapy (also called PDT, photoradiation therapy, phototherapy, or photochemotherapy) is used for the treatment of some types of cancer. It is based on the discovery that certain chemicals known as photosensitizing agents can kill one-celled organisms when the organisms are exposed to a particular type of light. PDT destroys cancer cells through the use of a fixed-frequency laser light in combination with a photosensitizing agent. In PDT, the photosensitizing agent is injected into the bloodstream and absorbed by cells all over the body. The agent remains in cancer cells for a longer time than it does in normal cells. When the treated cancer cells are exposed to laser light, the photosensitizing agent absorbs the light and produces an active form of oxygen that destroys the treated cancer cells. Light exposure must be timed carefully so that it occurs when most of the photosensitizing agent has left healthy cells but is still present in the cancer cells. The laser light used in PDT can be directed through a fiber-optic (a very thin glass strand). The fiber-optic is placed close to the cancer to deliver the proper amount of light. The fiber-optic can be directed through a bronchoscope into the lungs for the treatment of lung cancer or through an endoscope into the esophagus for the treatment of esophageal cancer. An advantage of PDT is that it causes minimal damage to healthy tissue. However, because the laser light currently in use cannot pass through more than about 3 centimeters of tissue (a little more than one and an eighth inch), PDT is mainly used to treat tumors on or just under the skin or on the lining of internal organs. Photodynamic therapy makes the skin and eyes sensitive to light for 6 weeks or more after treatment. Patients are advised to avoid direct sunlight and bright indoor light for at least 6 weeks. If patients must go outdoors, they need to wear protective clothing, including sunglasses. Other temporary side effects of PDT are related to the treatment of specific areas and can include coughing, trouble swallowing, abdominal pain, and painful breathing or shortness of breath. In December 1995, the U.S. Food and Drug Administration (FDA) approved a photosensitizing agent called porfimer sodium, or Photofrin®, to relieve symptoms of esophageal cancer that is causing an obstruction and for esophageal cancer that cannot be satisfactorily treated with lasers alone. In January 1998, the FDA approved porfimer sodium for the treatment of early nonsmall cell lung cancer in patients for whom the usual treatments for lung cancer are not appropriate. The National Cancer Institute and other institutions are supporting clinical trials (research studies) to evaluate the use of photodynamic therapy for several types of cancer, including cancers of the bladder, brain, larynx, and oral cavity.

In yet another embodiment, laser therapy is used to harness high-intensity light to destroy cancer cells. This technique is often used to relieve symptoms of cancer such as bleeding or obstruction, especially when the cancer cannot be cured by other treatments. It may also be used to treat cancer by shrinking or destroying tumors. The term "laser" stands for light amplification by stimulated emission of radiation. Ordinary light, such as that from a light bulb, has many wavelengths and spreads in all directions. Laser light, on the other hand, has a specific wavelength and is focused in a narrow beam. This type of high-intensity light contains a lot of energy. Lasers are very powerful and may be used to cut through steel or to shape diamonds. Lasers also can be used for very precise surgical work, such as repairing a damaged retina in the eye or cutting through tissue (in place of a scalpel). Although there are several different kinds of lasers, only three kinds have gained wide use in medicine: Carbon dioxide ($CO_2$) laser—This type of laser can remove thin layers from the skin's surface without penetrating the deeper layers. This technique is particularly useful in treating tumors that have not spread deep into the skin and certain precancerous conditions. As an alternative to traditional scalpel surgery, the $CO_2$ laser is also able to cut the skin. The laser is used in this way to remove skin cancers. Neodymium:yttrium-aluminum-garnet (Nd:YAG) laser—Light from this laser can penetrate deeper into tissue than light from the other types of lasers, and it can cause blood to clot quickly. It can be carried through optical fibers to less accessible parts of the body. This type of laser is sometimes used to treat throat cancers. Argon laser—This laser can pass through only superficial layers of tissue and is therefore useful in dermatology and in eye surgery. It also is used with light-sensitive dyes to treat tumors in a procedure known as photodynamic therapy (PDT). Lasers have several advantages over standard surgical tools, including: Lasers are more precise than scalpels. Tissue near an incision is protected, since there is little contact with surrounding skin or other tissue. The heat produced by lasers sterilizes the surgery site, thus reducing the risk of infection. Less operating time may be needed because the precision of the laser allows for a smaller incision. Healing time is often shortened; since laser heat seals blood vessels, there is less bleeding, swelling, or scarring. Laser surgery may be less complicated. For example, with fiber optics, laser light can be directed to parts of the body without making a large incision. More procedures may be done on an outpatient basis. Lasers can be used in two ways to treat cancer: by shrinking or destroying a tumor with heat, or by activating a chemical—known as a photosensitizing agent—that destroys cancer cells. In PDT, a photosensitizing agent is retained in cancer cells and can be stimulated by light to cause a reaction that kills cancer cells. $CO_2$ and Nd:YAG lasers are used to shrink or destroy tumors. They may be used with endoscopes, tubes that allow physicians to see into certain areas of the body, such as the bladder. The light from some lasers can be transmitted through a flexible endoscope fitted with fiber optics. This allows physicians to see and work in parts of the body that could not otherwise be reached except by surgery and therefore allows very precise aiming of the laser beam. Lasers also may be used with low-power microscopes, giving the doctor a clear view of the site being treated. Used with other instruments, laser systems can produce a cutting area as small as 200 microns in diameter—less than the width of a very fine thread. Lasers are used to treat many types of cancer. Laser surgery is a standard treatment for certain stages of glottis (vocal cord), cervical, skin, lung, vaginal, vulvar, and penile cancers. In addition to its use to destroy the cancer, laser surgery is also used to help relieve symptoms caused by cancer (palliative care). For example, lasers may be used to shrink or destroy a tumor that is blocking a patient's trachea (windpipe), making it easier to breathe. It is also sometimes used for palliation in colorectal and anal cancer. Laser-induced interstitial thermotherapy (LITT) is one of the most recent developments in laser therapy. LITT uses the same idea as a cancer treatment called hyperthermia; that heat may help shrink tumors by damaging cells or depriving them of substances they need to live. In this treatment, lasers are directed to interstitial areas (areas between organs) in the body. The laser light then raises the temperature of the tumor, which damages or destroys cancer cells.

The duration and/or dose of treatment with anti-immune checkpoint therapies may vary according to the particular anti-immune checkpoint agent or combination thereof. An appropriate treatment time for a particular cancer therapeutic agent will be appreciated by the skilled artisan. The present invention contemplates the continued assessment of optimal treatment schedules for each cancer therapeutic agent, where the phenotype of the cancer of the subject as determined by the methods of the present invention is a factor in determining optimal treatment doses and schedules.

Any means for the introduction of a polynucleotide into mammals, human or non-human, or cells thereof may be adapted to the practice of this invention for the delivery of the various constructs of the present invention into the intended recipient. In one embodiment of the present invention, the DNA constructs are delivered to cells by transfection, i.e., by delivery of "naked" DNA or in a complex with a colloidal dispersion system. A colloidal system includes macromolecule complexes, nanocapsules, microspheres, beads, and lipid-based systems including oil-in-water emulsions, micelles, mixed micelles, and liposomes. The preferred colloidal system of this invention is a lipid-complexed or liposome-formulated DNA. In the former approach, prior to formulation of DNA, e.g., with lipid, a plasmid containing a transgene bearing the desired DNA constructs may first be experimentally optimized for expression (e.g., inclusion of an intron in the 5' untranslated region and elimination of unnecessary sequences (Felgner, et al., Ann NY Acad Sci 126-139, 1995). Formulation of DNA, e.g. with various lipid or liposome materials, may then be effected using known methods and materials and delivered to the recipient mammal. See, e.g., Canonico et al, Am J Respir Cell Mol Biol 10:24-29, 1994; Tsan et al, Am J Physiol 268; Alton et al., Nat Genet. 5:135-142, 1993 and U.S. Pat. No. 5,679,647 by Carson et al.

The targeting of liposomes can be classified based on anatomical and mechanistic factors. Anatomical classification is based on the level of selectivity, for example, organ-specific, cell-specific, and organelle-specific. Mechanistic targeting can be distinguished based upon whether it is passive or active. Passive targeting utilizes the natural tendency of liposomes to distribute to cells of the reticuloendothelial system (RES) in organs, which contain sinusoidal capillaries. Active targeting, on the other hand, involves alteration of the liposome by coupling the liposome to a specific ligand such as a monoclonal antibody, sugar, glycolipid, or protein, or by changing the composition or size of the liposome in order to achieve targeting to organs and cell types other than the naturally occurring sites of localization.

The surface of the targeted delivery system may be modified in a variety of ways. In the case of a liposomal targeted delivery system, lipid groups can be incorporated into the lipid bilayer of the liposome in order to maintain the targeting ligand in stable association with the liposomal bilayer. Various linking groups can be used for joining the lipid chains to the targeting ligand. Naked DNA or DNA associated with a delivery vehicle, e.g., liposomes, can be administered to several sites in a subject (see below).

Nucleic acids can be delivered in any desired vector. These include viral or non-viral vectors, including adenovirus vectors, adeno-associated virus vectors, retrovirus vectors, lentivirus vectors, and plasmid vectors. Exemplary types of viruses include HSV (herpes simplex virus), AAV (adeno associated virus), HIV (human immunodeficiency virus), BIV (bovine immunodeficiency virus), and MLV (murine leukemia virus). Nucleic acids can be administered in any desired format that provides sufficiently efficient delivery levels, including in virus particles, in liposomes, in nanoparticles, and complexed to polymers.

The nucleic acids encoding a protein or nucleic acid of interest may be in a plasmid or viral vector, or other vector as is known in the art. Such vectors are well known and any can be selected for a particular application. In one embodiment of the present invention, the gene delivery vehicle comprises a promoter and a demethylase coding sequence. Preferred promoters are tissue-specific promoters and promoters which are activated by cellular proliferation, such as the thymidine kinase and thymidylate synthase promoters. Other preferred promoters include promoters which are activatable by infection with a virus, such as the α- and β-interferon promoters, and promoters which are activatable by a hormone, such as estrogen. Other promoters which can be used include the Moloney virus LTR, the CMV promoter, and the mouse albumin promoter. A promoter may be constitutive or inducible.

In another embodiment, naked polynucleotide molecules are used as gene delivery vehicles, as described in WO 90/11092 and U.S. Pat. No. 5,580,859. Such gene delivery vehicles can be either growth factor DNA or RNA and, in certain embodiments, are linked to killed adenovirus. Curiel et al., Hum. Gene. Ther. 3:147-154, 1992. Other vehicles which can optionally be used include DNA-ligand (Wu et al., J. Biol. Chem. 264:16985-16987, 1989), lipid-DNA combinations (Felgner et al., Proc. Natl. Acad. Sci. USA 84:7413 7417, 1989), liposomes (Wang et al., Proc. Natl. Acad. Sci. 84:7851-7855, 1987) and microprojectiles (Williams et al., Proc. Natl. Acad. Sci. 88:2726-2730, 1991).

A gene delivery vehicle can optionally comprise viral sequences such as a viral origin of replication or packaging signal. These viral sequences can be selected from viruses such as astrovirus, coronavirus, orthomyxovirus, papovavirus, paramyxovirus, parvovirus, picornavirus, poxvirus, retrovirus, togavirus or adenovirus. In a preferred embodiment, the growth factor gene delivery vehicle is a recombinant retroviral vector. Recombinant retroviruses and various uses thereof have been described in numerous references including, for example, Mann et al., Cell 33:153, 1983, Cane and Mulligan, Proc. Nat'l. Acad. Sci. USA 81:6349, 1984, Miller et al., Human Gene Therapy 1:5-14, 1990, U.S. Pat. Nos. 4,405,712, 4,861,719, and 4,980,289, and PCT Application Nos. WO 89/02,468, WO 89/05,349, and WO 90/02,806. Numerous retroviral gene delivery vehicles can be utilized in the present invention, including for example those described in EP 0,415,731; WO 90/07936; WO 94/03622; WO 93/25698; WO 93/25234; U.S. Pat. No. 5,219,740; WO 9311230; WO 9310218; Vile and Hart, Cancer Res. 53:3860-3864, 1993; Vile and Hart, Cancer Res. 53:962-967, 1993; Ram et al., Cancer Res. 53:83-88, 1993; Takamiya et al., J. Neurosci. Res. 33:493-503, 1992; Baba et al., J. Neurosurg. 79:729-735, 1993 (U.S. Pat. No. 4,777,127, GB 2,200,651, EP 0,345,242 and WO91/02805).

Other viral vector systems that can be used to deliver a polynucleotide of the present invention have been derived from herpes virus, e.g., Herpes Simplex Virus (U.S. Pat. No. 5,631,236 by Woo et al., issued May 20, 1997 and WO 00/08191 by Neurovex), vaccinia virus (Ridgeway (1988) Ridgeway, "Mammalian expression vectors," In: Rodriguez R L, Denhardt D T, ed. Vectors: A survey of molecular cloning vectors and their uses. Stoneham: Butterworth; Baichwal and Sugden (1986) "Vectors for gene transfer derived from animal DNA viruses: Transient and stable expression of transferred genes," In: Kucherlapati R, ed. Gene transfer. New York: Plenum Press; Coupar et al. (1988) Gene, 68:1-10), and several RNA viruses. Preferred viruses include an alphavirus, a poxivirus, an arena virus, a vaccinia virus, a polio virus, and the like. They offer several attractive features for various mammalian cells (Friedmann (1989) Science, 244:1275-1281; Ridgeway, 1988, supra; Baichwal and Sugden, 1986, supra; Coupar et al., 1988; Horwich et al. (1990) J. Virol., 64:642-650).

In other embodiments, target DNA in the genome can be manipulated using well-known methods in the art. For example, the target DNA in the genome can be manipulated by deletion, insertion, and/or mutation are retroviral insertion, artificial chromosome techniques, gene insertion, random insertion with tissue specific promoters, gene targeting, transposable elements and/or any other method for introducing foreign DNA or producing modified DNA/modified nuclear DNA. Other modification techniques include deleting DNA sequences from a genome and/or altering nuclear DNA sequences. Nuclear DNA sequences, for example, may be altered by site-directed mutagenesis.

In other embodiments, recombinant biomarker polypeptides, and fragments thereof, can be administered to subjects. In some embodiments, fusion proteins can be constructed and administered which have enhanced biological properties. In addition, the biomarker polypeptides, and fragment thereof, can be modified according to well-known pharmacological methods in the art (e.g., pegylation, glycosylation, oligomerization, etc.) in order to further enhance desirable biological activities, such as increased bioavailability and decreased proteolytic degradation.

4. Clincal Efficacy

Clinical efficacy can be measured by any method known in the art. For example, the response to a therapy, such as anti-immune checkpoint therapies, relates to any response of the cancer, e.g., a tumor, to the therapy, preferably to a change in tumor mass and/or volume after initiation of neoadjuvant or adjuvant chemotherapy. Tumor response may be assessed in a neoadjuvant or adjuvant situation where the size of a tumor after systemic intervention can be compared to the initial size and dimensions as measured by CT, PET, mammogram, ultrasound or palpation and the cellularity of a tumor can be estimated histologically and compared to the cellularity of a tumor biopsy taken before initiation of treatment. Response may also be assessed by caliper measurement or pathological examination of the tumor after biopsy or surgical resection. Response may be recorded in a quantitative fashion like percentage change in tumor volume or cellularity or using a semi-quantitative scoring system such as residual cancer burden (Symmans et al., *J. Clin. Oncol.* (2007) 25:4414-4422) or Miller-Payne score (Ogston et al., (2003) Breast (Edinburgh, Scotland) 12:320-327) in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of tumor response may be performed early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed.

In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular anti-immune checkpoint therapeutic regimen is at least 25%, 30%, 35%, 40%, 45%, 50%, 55%, 60%, 65%, 70%, 75%, 80%, 85%, or more.

Additional criteria for evaluating the response to antiimmune checkpoint therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence.

For example, in order to determine appropriate threshold values, a particular anti-immune checkpoint therapeutic regimen can be administered to a population of subjects and the outcome can be correlated to biomarker measurements that were determined prior to administration of any immune checkpoint therapy. The outcome measurement may be pathologic response to therapy given in the neoadjuvant setting. Alternatively, outcome measures, such as overall survival and disease-free survival can be monitored over a period of time for subjects following immune checkpoint therapy for whom biomarker measurement values are known. In certain embodiments, the same doses of antiimmune checkpoint agents are administered to each subject. In related embodiments, the doses administered are standard doses known in the art for anti-immune checkpoint agents. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of an immune checkpoint therapy can be determined using methods such as those described in the Examples section.

5. Further Uses and Methods of the Present Invention

The methods described herein can be used in a variety of diagnostic, prognostic, and therapeutic applications. In any method described herein, such as a diagnostic method, prognostic method, therapeutic method, or combination thereof, all steps of the method can be performed by a single actor or, alternatively, by more than one actor. For example, diagnosis can be performed directly by the actor providing therapeutic treatment. Alternatively, a person providing a therapeutic agent can request that a diagnostic assay be performed. The diagnostician and/or the therapeutic interventionist can interpret the diagnostic assay results to determine a therapeutic strategy. Similarly, such alternative processes can apply to other assays, such as prognostic assays. The compositions described herein can also be used in a variety of diagnostic, prognostic, and therapeutic applications regarding biomarkers described herein, such as those listed in Table 1. Moreover, any method of diagnosis, prognosis, prevention, and the like described herein can be be applied to a therapy or test agent of interest, such as immune checkpoint therapies, EGFR therapies, anti-cancer therapies, and the like.

a. Screening Methods

One aspect of the present invention relates to screening assays, including non-cell based assays. In one embodiment, the assays provide a method for identifying whether a cancer is likely to respond to immune checkpoint therapy and/or whether an agent can inhibit the growth of or kill a cancer cell that is unlikely to respond to immune checkpoint therapy.

In one embodiment, the present invention relates to assays for screening test agents which bind to, or modulate the biological activity of, at least one biomarker listed in Table 1. In one embodiment, a method for identifying such an agent entails determining the ability of the agent to modulate, e.g. inhibit, the at least one biomarker listed in Table 1.

In one embodiment, an assay is a cell-free or cell-based assay, comprising contacting at least one biomarker listed in Table 1, with a test agent, and determining the ability of the test agent to modulate (e.g. inhibit) the enzymatic activity of the biomarker, such as by measuring direct binding of substrates or by measuring indirect parameters as described below.

For example, in a direct binding assay, biomarker protein (or their respective target polypeptides or molecules) can be coupled with a radioisotope or enzymatic label such that binding can be determined by detecting the labeled protein or molecule in a complex. For example, the targets can be labeled with $^{125}$I, $^{35}$S, $^{14}$C, or $^{3}$H, either directly or indirectly, and the radioisotope detected by direct counting of radioemmission or by scintillation counting. Alternatively, the targets can be enzymatically labeled with, for example, horseradish peroxidase, alkaline phosphatase, or luciferase, and the enzymatic label detected by determination of conversion of an appropriate substrate to product. Determining the interaction between biomarker and substrate can also be accomplished using standard binding or enzymatic analysis assays. In one or more embodiments of the above described assay methods, it may be desirable to immobilize polypeptides or molecules to facilitate separation of complexed from uncomplexed forms of one or both of the proteins or molecules, as well as to accommodate automation of the assay.

Binding of a test agent to a target can be accomplished in any vessel suitable for containing the reactants. Non-limiting examples of such vessels include microtiter plates, test tubes, and micro-centrifuge tubes. Immobilized forms of the antibodies of the present invention can also include antibodies bound to a solid phase like a porous, microporous (with an average pore diameter less than about one micron) or macroporous (with an average pore diameter of more than about 10 microns) material, such as a membrane, cellulose, nitrocellulose, or glass fibers; a bead, such as that made of agarose or polyacrylamide or latex; or a surface of a dish, plate, or well, such as one made of polystyrene.

In an alternative embodiment, determining the ability of the agent to modulate the interaction between the biomarker and a substrate or a biomarker and its natural binding partner can be accomplished by determining the ability of the test agent to modulate the activity of a polypeptide or other product that functions downstream or upstream of its position within the signaling pathway (e.g., feedback loops). Such feedback loops are well-known in the art (see, for example, Chen and Guillemin (2009) *Int. J. Tryptophan Res.* 2:1-19).

The present invention further pertains to novel agents identified by the above-described screening assays. Accordingly, it is within the scope of this invention to further use an agent identified as described herein in an appropriate animal model. For example, an agent identified as described herein can be used in an animal model to determine the efficacy, toxicity, or side effects of treatment with such an agent. Alternatively, an antibody identified as described herein can be used in an animal model to determine the mechanism of action of such an agent.

b. Predictive Medicine

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining the amount and/or activity level of a biomarker listed in Table 1 in the context of a biological sample (e.g., blood, serum, cells, or tissue) to thereby determine whether an individual afflicted with a cancer is likely to respond to immune checkpoint therapy, whether in an original or recurrent cancer. Such assays can be used for prognostic or predictive purpose to thereby prophylactically treat an individual prior to the onset or after recurrence of a disorder characterized by or associated with biomarker polypeptide, nucleic acid expression or activity. The skilled artisan will appreciate that any method can use one or more (e.g., combinations) of biomarkers listed in Table 1.

Another aspect of the present invention pertains to monitoring the influence of agents (e.g., drugs, compounds, and small nucleic acid-based molecules) on the expression or activity of a biomarker listed in Table 1. These and other agents are described in further detail in the following sections.

The skilled artisan will also appreciate that, in certain embodiments, the methods of the present invention implement a computer program and computer system. For example, a computer program can be used to perform the algorithms described herein. A computer system can also store and manipulate data generated by the methods of the present invention which comprises a plurality of biomarker signal changes/profiles which can be used by a computer system in implementing the methods of this invention. In certain embodiments, a computer system receives biomarker expression data; (ii) stores the data; and (iii) compares the data in any number of ways described herein (e.g., analysis relative to appropriate controls) to determine the state of informative biomarkers from cancerous or pre-cancerous tissue. In other embodiments, a computer system (i) compares the determined expression biomarker level to a threshold value; and (ii) outputs an indication of whether said biomarker level is significantly modulated (e.g., above or below) the threshold value, or a phenotype based on said indication.

In certain embodiments, such computer systems are also considered part of the present invention. Numerous types of computer systems can be used to implement the analytic methods of this invention according to knowledge possessed by a skilled artisan in the bioinformatics and/or computer arts. Several software components can be loaded into memory during operation of such a computer system. The software components can comprise both software components that are standard in the art and components that are special to the present invention (e.g., dCHIP software described in Lin et al. (2004) *Bioinformatics* 20, 1233-1240; radial basis machine learning algorithms (RBM) known in the art).

The methods of the present invention can also be programmed or modeled in mathematical software packages that allow symbolic entry of equations and high-level specification of processing, including specific algorithms to be used, thereby freeing a user of the need to procedurally program individual equations and algorithms. Such packages include, e.g., Matlab from Mathworks (Natick, Mass.), Mathematica from Wolfram Research (Champaign, Ill.) or S-Plus from MathSoft (Seattle, Wash.).

In certain embodiments, the computer comprises a database for storage of biomarker data. Such stored profiles can be accessed and used to perform comparisons of interest at a later point in time. For example, biomarker expression profiles of a sample derived from the non-cancerous tissue of a subject and/or profiles generated from population-based distributions of informative loci of interest in relevant populations of the same species can be stored and later compared to that of a sample derived from the cancerous tissue of the subject or tissue suspected of being cancerous of the subject.

In addition to the exemplary program structures and computer systems described herein, other, alternative program structures and computer systems will be readily apparent to the skilled artisan. Such alternative systems, which do not depart from the above described computer system and programs structures either in spirit or in scope, are therefore intended to be comprehended within the accompanying claims.

c. Diagnostic Assays

The present invention provides, in part, methods, systems, and code for accurately classifying whether a biological sample is associated with a cancer that is likely to respond to immune checkpoint therapy. In some embodiments, the present invention is useful for classifying a sample (e.g., from a subject) as associated with or at risk for responding to or not responding to immune checkpoint therapy using a statistical algorithm and/or empirical data (e.g., the amount or activity of a biomarker listed in Table 1).

An exemplary method for detecting the amount or activity of a biomarker listed in Table 1, and thus useful for classifying whether a sample is likely or unlikely to respond to immune checkpoint therapy involves obtaining a biological sample from a test subject and contacting the biological sample with an agent, such as a protein-binding agent like an antibody or antigen-binding fragment thereof, or a nucleic acid-binding agent like an oligonucleotide, capable of detecting the amount or activity of the biomarker in the biological sample. In some embodiments, at least one antibody or antigen-binding fragment thereof is used, wherein two, three, four, five, six, seven, eight, nine, ten, or more such antibodies or antibody fragments can be used in combination (e.g., in sandwich ELISAs) or in serial. In certain instances, the statistical algorithm is a single learning statistical classifier system. For example, a single learning statistical classifier system can be used to classify a sample as a based upon a prediction or probability value and the presence or level of the biomarker. The use of a single learning statistical classifier system typically classifies the sample as, for example, a likely immune checkpoint therapy responder or progressor sample with a sensitivity, specificity, positive predictive value, negative predictive value, and/or overall accuracy of at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Other suitable statistical algorithms are well known to those of skill in the art. For example, learning statistical classifier systems include a machine learning algorithmic technique capable of adapting to complex data sets (e.g., panel of markers of interest) and making decisions based upon such data sets. In some embodiments, a single learning statistical classifier system such as a classification tree (e.g., random forest) is used. In other embodiments, a combination of 2, 3, 4, 5, 6, 7, 8, 9, 10, or more learning statistical classifier systems are used, preferably in tandem. Examples of learning statistical classifier systems include, but are not limited to, those using inductive learning (e.g., decision/classification trees such as random forests, classification and regression trees (C&RT), boosted trees, etc.), Probably Approximately Correct (PAC) learning, connectionist learning (e.g., neural networks (NN), artificial neural networks (ANN), neuro fuzzy networks (NFN), network structures, perceptrons such as multi-layer perceptrons, multi-layer feed-forward networks, applications of neural networks, Bayesian learning in belief networks, etc.), reinforcement learning (e.g., passive learning in a known environment such as naive learning, adaptive dynamic learning, and temporal difference learning, passive learning in an unknown environment, active learning in an unknown environment, learning action-value functions, applications of reinforcement learning, etc.), and genetic algorithms and evolutionary programming. Other learning statistical classifier systems include support vector machines (e.g., Kernel methods), multivariate adaptive regression splines (MARS), Levenberg-Marquardt algorithms, Gauss-Newton algorithms, mixtures of Gaussians, gradient descent algorithms, and learning vector quantization (LVQ). In certain embodiments, the method of the present invention further comprises sending the sample classification results to a clinician, e.g., an oncologist.

In another embodiment, the diagnosis of a subject is followed by administering to the individual a therapeutically effective amount of a defined treatment based upon the diagnosis.

In one embodiment, the methods further involve obtaining a control biological sample (e.g., biological sample from a subject who does not have a cancer or whose cancer is susceptible to immune checkpoint therapy), a biological sample from the subject during remission, or a biological sample from the subject during treatment for developing a cancer progressing despite immune checkpoint therapy.

d. Prognostic Assays

The diagnostic methods described herein can furthermore be utilized to identify subjects having or at risk of developing a cancer that is likely or unlikely to be responsive to immune checkpoint therapy. The assays described herein, such as the preceding diagnostic assays or the following assays, can be utilized to identify a subject having or at risk of developing a disorder associated with a misregulation of the amount or activity of at least one biomarker described in Table 1, such as in cancer. Alternatively, the prognostic assays can be utilized to identify a subject having or at risk for developing a disorder associated with a misregulation of the at least one biomarker described in Table 1, such as in cancer. Furthermore, the prognostic assays described herein can be used to determine whether a subject can be administered an agent (e.g., an agonist, antagonist, peptidomimetic, polypeptide, peptide, nucleic acid, small molecule, or other drug candidate) to treat a disease or disorder associated with the aberrant biomarker expression or activity.

e. Treatment Methods

The compositions described herein (including dual binding antibodies and derivatives and conjugates thereof) can be used in a variety of in vitro and in vivo therapeutic applications using the formulations and/or combinations described herein. In one embodiment, anti-immune checkpoint agents can be used to treat cancers determined to be responsive thereto. For example, antibodies that block the interaction between PD-L1, PD-L2, and/or CTLA-4 and their receptors (e.g., PD-L1 binding to PD-1, PD-L2 binding to PD-1, and the like) can be used to treat cancer in subjects identified as likely responding thereto.

6. Pharmaceutical Compositions

In another aspect, the present invention provides pharmaceutically acceptable compositions which comprise a therapeutically-effective amount of an agent that modulates (e.g., decreases) biomarker expression and/or activity, formulated together with one or more pharmaceutically acceptable carriers (additives) and/or diluents. As described in detail below, the pharmaceutical compositions of the present invention may be specially formulated for administration in solid or liquid form, including those adapted for the following: (1) oral administration, for example, drenches (aqueous or non-aqueous solutions or suspensions), tablets, boluses, powders, granules, pastes; (2) parenteral administration, for example, by subcutaneous, intramuscular or intravenous injection as, for example, a sterile solution or suspension; (3) topical application, for example, as a cream, ointment or spray applied to the skin; (4) intravaginally or intrarectally, for example, as a pessary, cream or foam; or (5) aerosol, for example, as an aqueous aerosol, liposomal preparation or solid particles containing the compound.

The phrase "therapeutically-effective amount" as used herein means that amount of an agent that modulates (e.g., inhibits) biomarker expression and/or activity, or expression and/or activity of the complex, or composition comprising an agent that modulates (e.g., inhibits) biomarker expression and/or activity, or expression and/or activity of the complex, which is effective for producing some desired therapeutic effect, e.g., cancer treatment, at a reasonable benefit/risk ratio.

The phrase "pharmaceutically acceptable" is employed herein to refer to those agents, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, solvent or encapsulating material, involved in carrying or transporting the subject chemical from one organ, or portion of the body, to another organ, or portion of the body. Each carrier must be "acceptable" in the sense of being compatible with the other ingredients of the formulation and not injurious to the subject. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) phosphate buffer solutions; and (21) other non-toxic compatible substances employed in pharmaceutical formulations.

The term "pharmaceutically-acceptable salts" refers to the relatively non-toxic, inorganic and organic acid addition salts of the agents that modulates (e.g., inhibits) biomarker expression and/or activity, or expression and/or activity of the complex encompassed by the present invention. These salts can be prepared in situ during the final isolation and purification of the respiration uncoupling agents, or by separately reacting a purified respiration uncoupling agent in its free base form with a suitable organic or inorganic acid, and isolating the salt thus formed. ReRepresentative salts include the hydrobromide, hydrochloride, sulfate, bisulfate, phosphate, nitrate, acetate, valerate, oleate, palmitate, stearate, laurate, benzoate, lactate, phosphate, tosylate, citrate, maleate, fumarate, succinate, tartrate, napthylate, mesylate, glucoheptonate, lactobionate, and laurylsulphonate salts and the like (See, for example, Berge et al. (1977) "Pharmaceutical Salts", $J.$ $Pharm.$ $Sci.$ 66:1-19).

In other cases, the agents useful in the methods of the present invention may contain one or more acidic functional groups and, thus, are capable of forming pharmaceutically-acceptable salts with pharmaceutically-acceptable bases. The term "pharmaceutically-acceptable salts" in these instances refers to the relatively non-toxic, inorganic and organic base addition salts of agents that modulates (e.g., inhibits) biomarker expression and/or activity, or expression and/or activity of the complex. These salts can likewise be prepared in situ during the final isolation and purification of the respiration uncoupling agents, or by separately reacting the purified respiration uncoupling agent in its free acid form with a suitable base, such as the hydroxide, carbonate or bicarbonate of a pharmaceutically-acceptable metal cation, with ammonia, or with a pharmaceutically-acceptable organic primary, secondary or tertiary amine. ReRepresentative alkali or alkaline earth salts include the lithium, sodium, potassium, calcium, magnesium, and aluminum salts and the like. ReRepresentative organic amines useful for the formation of base addition salts include ethylamine, diethylamine, ethylenediamine, ethanolamine, diethanolamine, piperazine and the like (see, for example, Berge et al., supra).

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically-acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Formulations useful in the methods of the present invention include those suitable for oral, nasal, topical (including buccal and sublingual), rectal, vaginal, aerosol and/or parenteral administration. The formulations may conveniently be presented in unit dosage form and may be prepared by any methods well known in the art of pharmacy. The amount of active ingredient which can be combined with a carrier material to produce a single dosage form will vary depending upon the host being treated, the particular mode of administration. The amount of active ingredient, which can be combined with a carrier material to produce a single dosage form will generally be that amount of the compound which produces a therapeutic effect. Generally, out of one hundred percent, this amount will range from about 1 percent to about ninety-nine percent of active ingredient, preferably from about 5 percent to about 70 percent, most preferably from about 10 percent to about 30 percent.

Methods of preparing these formulations or compositions include the step of bringing into association an agent that modulates (e.g., inhibits) biomarker expression and/or activity, with the carrier and, optionally, one or more accessory ingredients. In general, the formulations are prepared by uniformly and intimately bringing into association a respiration uncoupling agent with liquid carriers, or finely divided solid carriers, or both, and then, if necessary, shaping the product.

Formulations suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a respiration uncoupling agent as an active ingredient. A compound may also be administered as a bolus, electuary or paste.

In solid dosage forms for oral administration (capsules, tablets, pills, dragees, powders, granules and the like), the active ingredient is mixed with one or more pharmaceutically-acceptable carriers, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets and pills, the pharmaceutical compositions may also comprise buffering agents. Solid compositions of a similar type may also be employed as fillers in soft and hard-filled gelatin capsules using such excipients as lactose or milk sugars, as well as high molecular weight polyethylene glycols and the like.

A tablet may be made by compression or molding, optionally with one or more accessory ingredients. Compressed tablets may be prepared using binder (for example, gelatin or hydroxypropylmethyl cellulose), lubricant, inert diluent, preservative, disintegrant (for example, sodium starch glycolate or cross-linked sodium carboxymethyl cellulose), surface-active or dispersing agent. Molded tablets may be made by molding in a suitable machine a mixture of the powdered peptide or peptidomimetic moistened with an inert liquid diluent.

Tablets, and other solid dosage forms, such as dragees, capsules, pills and granules, may optionally be scored or prepared with coatings and shells, such as enteric coatings and other coatings well known in the pharmaceutical-formulating art. They may also be formulated so as to provide slow or controlled release of the active ingredient therein using, for example, hydroxypropylmethyl cellulose in varying proportions to provide the desired release profile, other polymer matrices, liposomes and/or microspheres. They may be sterilized by, for example, filtration through a bacteria-retaining filter, or by incorporating sterilizing agents in the form of sterile solid compositions, which can be dissolved in sterile water, or some other sterile injectable medium immediately before use. These compositions may also optionally contain opacifying agents and may be of a composition that they release the active ingredient(s) only, or preferentially, in a certain portion of the gastrointestinal tract, optionally, in a delayed manner. Examples of embedding compositions, which can be used include polymeric substances and waxes. The active ingredient can also be in micro-encapsulated form, if appropriate, with one or more of the above-described excipients.

Liquid dosage forms for oral administration include pharmaceutically acceptable emulsions, microemulsions, solutions, suspensions, syrups and elixirs. In addition to the active ingredient, the liquid dosage forms may contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof.

Besides inert diluents, the oral compositions can also include adjuvants such as wetting agents, emulsifying and suspending agents, sweetening, flavoring, coloring, perfuming and preservative agents.

Suspensions, in addition to the active agent may contain suspending agents as, for example, ethoxylated isostearyl alcohols, polyoxyethylene sorbitol and sorbitan esters, microcrystalline cellulose, aluminum metahydroxide, bentonite, agar-agar and tragacanth, and mixtures thereof.

Formulations for rectal or vaginal administration may be presented as a suppository, which may be prepared by mixing one or more respiration uncoupling agents with one or more suitable nonirritating excipients or carriers comprising, for example, cocoa butter, polyethylene glycol, a suppository wax or a salicylate, and which is solid at room temperature, but liquid at body temperature and, therefore, will melt in the rectum or vaginal cavity and release the active agent.

Formulations which are suitable for vaginal administration also include pessaries, tampons, creams, gels, pastes, foams or spray formulations containing such carriers as are known in the art to be appropriate.

Dosage forms for the topical or transdermal administration of an agent that modulates (e.g., inhibits) biomarker expression and/or activity include powders, sprays, ointments, pastes, creams, lotions, gels, solutions, patches and inhalants. The active component may be mixed under sterile conditions with a pharmaceutically-acceptable carrier, and with any preservatives, buffers, or propellants which may be required.

The ointments, pastes, creams and gels may contain, in addition to a respiration uncoupling agent, excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain, in addition to an agent that modulates (e.g., inhibits) biomarker expression and/or activity, excipients such as lactose, talc, silicic acid, aluminum hydroxide, calcium silicates and polyamide powder, or mixtures of these substances. Sprays can additionally contain customary propellants, such as chlorofluorohydrocarbons and volatile unsubstituted hydrocarbons, such as butane and propane.

The agent that modulates (e.g., inhibits) biomarker expression and/or activity, can be alternatively administered by aerosol. This is accomplished by preparing an aqueous aerosol, liposomal preparation or solid particles containing the compound. A nonaqueous (e.g., fluorocarbon propellant) suspension could be used. Sonic nebulizers are preferred because they minimize exposing the agent to shear, which can result in degradation of the compound.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Transdermal patches have the added advantage of providing controlled delivery of a respiration uncoupling agent to the body. Such dosage forms can be made by dissolving or dispersing the agent in the proper medium. Absorption enhancers can also be used to increase the flux of the peptidomimetic across the skin. The rate of such flux can be controlled by either providing a rate controlling membrane or dispersing the peptidomimetic in a polymer matrix or gel.

Ophthalmic formulations, eye ointments, powders, solutions and the like, are also contemplated as being within the scope of this invention.

Pharmaceutical compositions of this invention suitable for parenteral administration comprise one or more respiration uncoupling agents in combination with one or more pharmaceutically-acceptable sterile isotonic aqueous or nonaqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents.

Examples of suitable aqueous and nonaqueous carriers which may be employed in the pharmaceutical compositions of the present invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of the action of microorganisms may be ensured by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution, which, in turn, may depend upon crystal size and crystalline form. Alternatively, delayed absorption of a parenterally-administered drug form is accomplished by dissolving or suspending the drug in an oil vehicle.

Injectable depot forms are made by forming microencapsule matrices of an agent that modulates (e.g., inhibits) biomarker expression and/or activity, in biodegradable polymers such as polylactide-polyglycolide. Depending on the ratio of drug to polymer, and the nature of the particular polymer employed, the rate of drug release can be controlled. Examples of other biodegradable polymers include poly(orthoesters) and poly(anhydrides). Depot injectable formulations are also prepared by entrapping the drug in liposomes or microemulsions, which are compatible with body tissue.

When the respiration uncoupling agents of the present invention are administered as pharmaceuticals, to humans and animals, they can be given per se or as a pharmaceutical composition containing, for example, 0.1 to 99.5% (more preferably, 0.5 to 90%) of active ingredient in combination with a pharmaceutically acceptable carrier.

Actual dosage levels of the active ingredients in the pharmaceutical compositions of this invention may be determined by the methods of the present invention so as to obtain an amount of the active ingredient, which is effective to achieve the desired therapeutic response for a particular subject, composition, and mode of administration, without being toxic to the subject.

The nucleic acid molecules of the present invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054 3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The present invention also encompasses kits for detecting and/or modulating biomarkers described herein. A kit of the present invention may also include instructional materials disclosing or describing the use of the kit or an antibody of the disclosed invention in a method of the disclosed invention as provided herein. A kit may also include additional components to facilitate the particular application for which the kit is designed. For example, a kit may additionally contain means of detecting the label (e.g., enzyme substrates for enzymatic labels, filter sets to detect fluorescent labels, appropriate secondary labels such as a sheep anti-mouse-HRP, etc.) and reagents necessary for controls (e.g., control biological samples or standards). A kit may additionally include buffers and other reagents recognized for use in a method of the disclosed invention. Non-limiting examples include agents to reduce non-specific binding, such as a carrier protein or a detergent.

EXEMPLIFICATION

This invention is further illustrated by the following examples, which should not be construed as limiting.

Example 1: Materials and Methods for Examples 2-3 a. Meta-Analysis: Cohort Consolidation

Mutation annotation files, HLA types, and clinical annotations were obtained from published data. Standardized pipelines for somatic variant calling, mutational signature deconvolution, and neoantigen prediction were used. Patients were stratified into clinical benefit (CB) and no clinical benefit (NCB) as described in Van Allen et al. (2015) *Science* 350:207-211. Analyses were repeated using two other published response metrics (CB=PFS>6 months; CB=CR or PR; see at least Rizvi et al. (2015) *Science* 348:124-128 and Snyder et al. (2014) *N. Engl. J. Med.* 371:2189-2199).

Specifically, pre-treatment tumors from patients who received immune checkpoint blockade for metastatic cancer at the DFCI and partner institutions were sequenced at the Broad Institute (FIG. 1). Data sources listed in FIG. 1 include data from Zaretsky et al. (2016) *New Engl. J. Med.* 375:819-829 disclosing 4 patients treated with anti-PD-1 therapy for metastatic melanoma (Zaretsky); Van Allen et al. (2015) *Science* 350:207-211 disclosing treatment of metastatic melanoma patients across Germany with anti-CTLA-4 ipilimumab therapy (Schadendorf); Hugo et al. (2016) *Cell* 165:35-44 (Hugo); Rizvi et al. (2015) *Science* 348:124-128 (Rizvi); Snyder et al. (2014) *N. Engl. J. Med.* 371:2189-2199 (Synder); and samples obtained from patients treated with immune checkpoint therapies with clinical monitoring at the Dana-Farber Cancer Institute (DFCI, CANSEQ, Broad-Next10, and Rizwan Haq). For example, samples from 2 patients for WES obtained from Dana-Farber Cancer Institute attending physician, Rizwan Haq (Rizwan Haq). Cancer types included melanoma, non-small-cell lung cancer, bladder cancer, anal cancer, sarcoma, head and neck squamous cell carcinoma, including one previously published cohort in Van Allen et al. (2015) *Science* 350:207-211. Quality controls were included based on exclusion criteria and inclusion criteria (FIG. 2).

In addition, whole exome data from published clinical cohorts of patients who received immune checkpoint therapy for metastatic non-small-cell lung cancer (Rizvi et al. (2015) *Science* 348:124-128) and melanoma (Snyder et al. (2014) *N. Engl. J. Med.* 371:2189-2199; Hugo et al. (2016) *Cell* 165:35-44) were used in the meta-analysis.

In separate meta-analyses described in Example 3 below, mutation annotation files, HLA types, and clinical annotations were obtained from published data. In particular, published mutation annotation files (MAFs), clinical annotations, and neoantigen files were taken from the supplemental information of Rizvi et al. (2015) *Science* 348:124-128; Van Allen et al. (2015) *Science* 350:207-211; and Snyder et al. (2014) *N. Engl. J. Med.* 371:2189-2199. These files were joined to form the meta-analysis cohort. Enrichment in mutations in specific genes was assessed in this joined cohort using Fisher's exact test. The joined MAF was also processed through MutSigCV to identify genes significantly mutated throughout the cohort. Thus, standardized pipelines for somatic variant calling, mutational signature deconvolution, and neoantigen prediction were used. Patients were stratified into clinical benefit (CB) and no clinical benefit (NCB) as described in Van Allen et al. (2015) *Science* 350:207-211. Analyses were repeated using two other published response metrics (CB=PFS>6 months; CB=CR or PR).

b. Sample Preparation, DNA and RNA Extraction, and Sequencing

Sample preparation, DNA and RNA extraction, and sequencing information vary slightly between the studies described in Rizvi et al. (2015) *Science* 348:124-128; Van Allen et al. (2015) *Science* 350:207-211; and Snyder et al. (2014) *N. Engl. J. Med.* 371:2189-2199, and particular details of such methods used can be found in the supplemental information files of these three publications.

For other samples, such as metastatic melanoma samples described in Example 3, or unless otherwise described, sample preparation, DNA and RNA extraction, and sequencing information proceeded as described below. Briefly, after fixation and mounting, 5-10 10 μm slices from formalin-fixed, paraffin-embedded (FFPE) tumor blocks were obtained, and tumor-enriched tissue was macrodissected. Paraffin was removed from FFPE sections and cores using CitriSolv™ (Fisher Scientific, Hampton, N.H.), followed by ethanol washes and tissue lysis overnight at 56° C. Samples were then incubated at 90° C. to remove DNA crosslinks, and DNA- and when possible, RNA-extraction was performed using Qiagen AllPrep DNA/RNA Mini Kit (#51306, Qiagen, Hilden, Germany). Germline DNA was obtained from adjacent PBMCs.

Whole exome and whole transcriptome sequencing of tumor and germline samples were performed as previously described (Van Allen et al. (2015) *Science* 350:207-211; Van Allen et al. (2014) *Nat. Med.* 20:682-688). All samples in the training cohort were sequenced using the Illumina exome, while a portion of the samples in the validation cohort were sequenced using the Agilent exome (Table 3A). The Illumina exome uses Illumina's in-solution DNA probe based hybrid selection method to target approximately 37.7 Mb of mainly exonic territory, using similar principles as the Broad Institute-Agilent Technologies developed in-solution RNA probe based hybrid selection method (Agilent SureSelect™ All Exon V2) (Fisher et al. (2011) *Genome Biol.* 12:R1; Gnirke et al. (2009) *Nat. Biotechnol.* 27:182-189) to generate Illumina exome sequencing libraries.

Pooled libraries were normalized to 2 nM and denatured using 0.2 N NaOH prior to sequencing. Flowcell cluster amplification and sequencing were performed according to the manufacturer's protocols using either the HiSeq 2000 v3 or HiSeq 2500. Each run was a 76 bp paired-end with a dual eight-base index barcode read. Data was analyzed using the Broad Picard Pipeline, which includes de-multiplexing and data aggregation.

Exome sequence data processing was performed using established analytical pipelines at the Broad Institute. A BAM file was produced using the Picard pipeline (at the World Wide Web address of picard.sourceforge.net), which aligns the tumor and normal sequences to the hg19 human genome build using Illumina sequencing reads. The BAM was uploaded into the Firehose pipeline (at the World Wide Web address of broadinstitute.org/cancer/cga/Firehose), which manages input and output files to be executed by GenePattern (Reich et al. (2006) *Nat. Genet.* 38:500-501). Samples with mean target coverage less than 25× in the tumor and less than 15× in matched normal were excluded. Quality control modules within Firehose were applied to all sequencing data for comparison of the origin of tumor and normal genotypes and to assess fingerprinting concordance. Cross-contamination of samples was estimated using ConTest (Cibulskis et al. (2011) *Bioinformatics* 27:2601-2602). Samples with ContEst estimates exceeding 5% were excluded from analysis.

c. Whole Exome and Whole Transcriptome Analyses

MuTect was applied to identify somatic single-nucleotide variants (Cibulskis et al. (2013) *Nat. Biotechnol.* 31:213-219). Strelka was used to identify somatic insertions and deletions (Saunders et al. (2012) *Bioinformatics* 28:1811-1817) across the whole exome. Indelocator, which detects small insertions and deletions after local realignment of tumor and normal sequences, was additionally applied to provide further sensitivity to detect indels in PBRM1 (Cancer Genome Atlas Research (2011) *Nature* 474:609-615). The union of indels called by Strelka and Indelocator was used for final analysis. Artifacts introduced by DNA oxidation during sequencing were computationally removed using a filter-based method (Costello et al. (2013) *Nuc. Acids Res.* 41:e67). All somatic mutations detected by whole-exome sequencing were analyzed for potential false positive calls by performing a comparison to mutation calls from a panel of 2,500 germline DNA samples (Stachler et al. (2015) *Nat. Genet.* 47:1047-1055). Mutations found in germline samples were removed from analysis. Annotation of identified variants was done using Oncotator (available at the World Wide Web address of www.broadinstitute.org/cancer/cga/oncotator). All nonsynonymous alterations in PBRM1 were manually reviewed in Integrated Genomics Viewer (IGV_2.3.57) for sequencing quality (Thorvaldsdottir et al. (2013) *Brief Bioinform* 14:178-192).

Copy ratios were calculated for each captured target by dividing the tumor coverage by the median coverage obtained in a set of reference normal samples. The resulting copy ratios were segmented using the circular binary segmentation algorithm (Olshen et al. (2004) *Biostatistics* 5:557-572). Allelic copy number alterations were called while taking into account sample-specific overall chromosomal aberrations (focality) (Brastianos et al. (2015) *Cancer Discov.* 5:1164-1177). Inference of mutational clonality, tumor purity, and tumor ploidy was accomplished with ABSOLUTE (Carter et al. (2012) *Nat Biotechnol.* 30:413-421). Samples had to have estimated tumor purity greater than 10% to be included in the final analysis. As a final quality control metric to ensure adequate sequencing coverage and tumor purity to detect relevant oncogenic events, all samples had to have at least one nonsynonymous mutation in at least one high confidence or candidate cancer driver gene to be included in the final analysis (Tamborero et al. (2013) *Sci. Rep.* 3:2650).

The 4-digit HLA type for each sample was inferred using Polysolver (Shukla et al. (2015) *Nat. Biotechnol.* 33:1152-1158). Neo-epitopes were predicted for each patient by defining all novel amino acid 9mers and 10mers resulting from each single nucleotide polymorphism and indel and determining whether the predicted binding affinity to the patient's germline HLA alleles was <500 nM using NetMHCpan (v2.4) (Hoof et al. (2009) *Immunogenetics* 61:1-13; Karosiene et al. (2013) *Immunogenetics* 65:711-724; Nielsen et al. (2007) *PLoS One* 2:e796).

Statistical analyses were also applied and are described further herein.

Example 2: Meta-Analysis of Genomic Predictors of Response to Immune Checkpoint Therapy Across a Variety of Cancers A large cohort of whole-exome-sequenced pre-treatment tumors were gathered from subjects who received immune checkpoint therapies for various cancers, were gathered and assessed for mutations associated with differential response to immune checkpoint therapies. Tumor types included in this discovery cohort included bladder cancer, renal cell carcinoma, lung cancer, and head and neck squamous cell carcinoma. Tumor-specific (somatic) mutations were assessed in all sequenced tumors to generate mutation annotation files (MAFs), which were later joined with MAFs from previously published studies in clinical cohorts in melanoma (Van Allen et al. (2015) *Science* 350:207-211; Snyder et al. (2014) *N. Engl. J. Med.* 371:2189-2199; Hugo et al. (2016) *Cell* 165:35-44) and non-small cell lung cancer (Rizvi et al. (2015) *Science* 348:124-128).

In particular, pre-treatment samples from cancer patients (N=268) were tested for their genetic sequences in relation to results of immune checkpoint therapy experienced by the cancer patients (FIG. 3). The results are shown in Table 2 as response by cancer type.

TABLE 2

|  | Melanoma | Lung | HNSCC | Sarcoma | Bladder |
| --- | --- | --- | --- | --- | --- |
| Clinical benefit | 66 (38.6%) | 20 (29.4%) | 4 (28.6%) | 1 (100%) | 6 (46.2%) |
| Intermediate benefit | 6 (3.5%) | 23 (33.8%) | 3 (21.4%) | 0 | 1 (7.7%) |
| No clinical benefit | 96 (56.1%) | 25 (36.8%) | 7 (50.0%) | 0 | 4 (30.8%) |
| Mixed response or not evaluable | 3 (1.8%) | 0 | 0 | 0 | 2 (1.5%) |
| Total | 171 | 68 | 14 | 1 | 13 |

Nonsynonymous mutational burden is a strong predictor of clinical outcomes across cancer types. As shown in FIG. 4, patients experiencing clinical benefit to immune checkpoint therapy had significantly more nonsynonymous mutations than those experiencing no clinical benefit (p=5.52e–06; Wilcoxon rank-sum). Such relationship is strong for patients with lung cancer (p=5.2e–05) and also significant for patients with bladder cancer (p=0.019) and melanoma (p=0.0016). No relationship between clinical outcome and mutational burden in HNSCC (p=0.45) was found. In addition, complete responders in sarcoma and anal cancer had unexceptional mutational burdens (below and near median, respectively).

In order to identify biomarkers associated with response or nonresponse to immune checkpoint blockade, the following procedure was conducted:

Split all patients into responders and non-responders
    Version A: N=98 CB vs. N=132 NCB
    Version B: N=98 CB vs. N=165 NCB or IB
Calculate significance value for enrichment of mutations in a given gene in responder or non-responders (Fisher's exact test)
    Version A: All nonsynonymous mutations
    Version B: Only truncating alterations (frame-shift insertions and deletions, nonsense single nucleotide polymorphisms, splice-site alterations)
Run MutSigCV on all 268 patients with called mutations to determine significantly mutated genes across the entire cohort, which takes into account gene size, patient-specific mutational rate, mutational spectra, and gene replication rates and times
Select genes that are mutated significantly more often in responders or non-responders (p<0.05) and pass MutSigCV significance (q<0.1; FDR).

Figure 5:
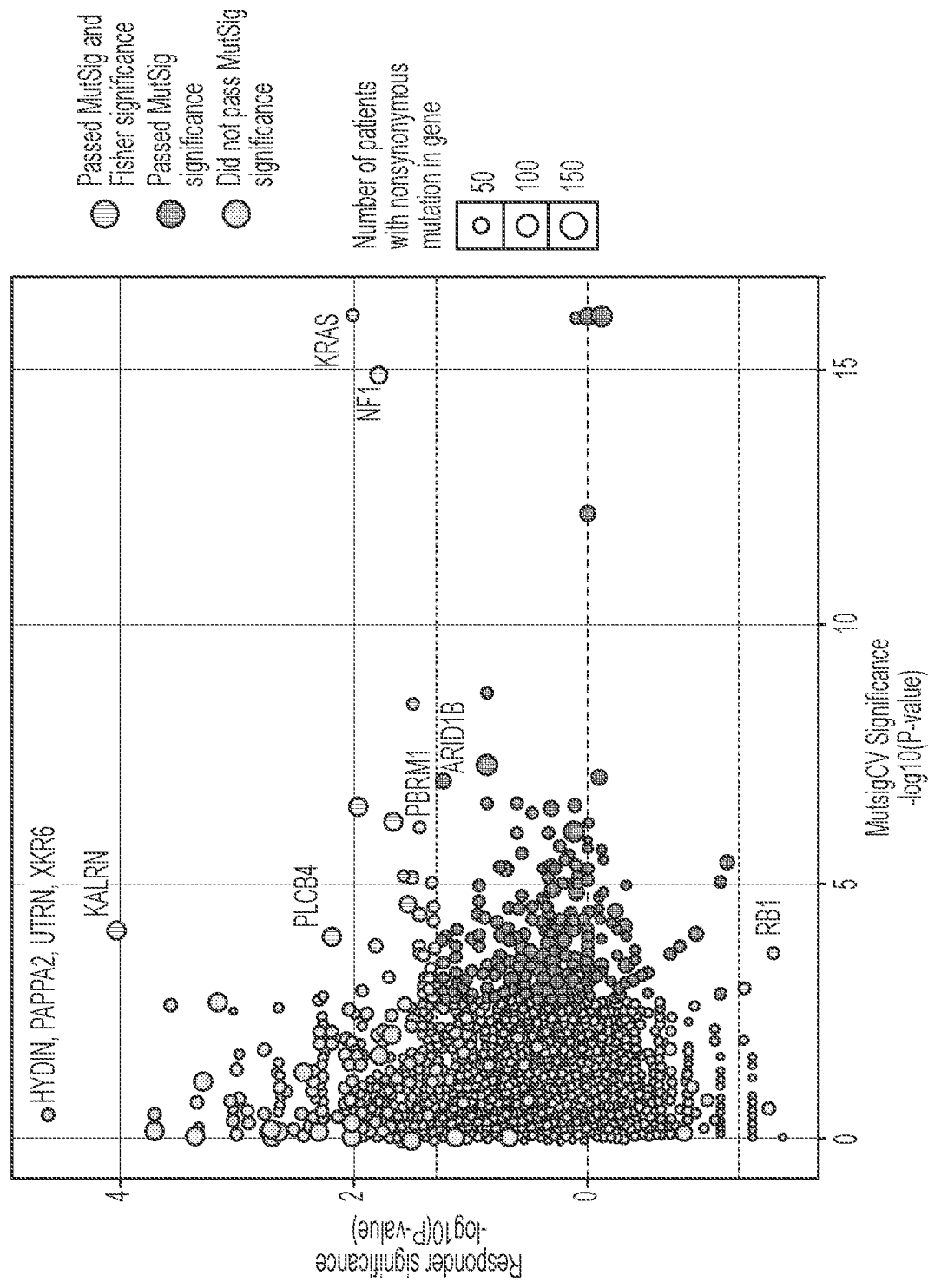
FIG. 5 shows genes significantly mutated in responders vs. non-responders.

The identified biomarkers are shown in FIG. 5. Table 3 is a summary of all genes with significantly more nonsynonymous mutations in R (N=98) or NR (N=132).

TABLE 3

| Gene | N (R) | N (NR) | p-value (Fisher's exact) |
| --- | --- | --- | --- |
| CETP | 4 | 0 | 0.032 |
| COL3A1 | 18 | 10 | 0.015 |
| COL5A1 | 22 | 15 | 0.029 |
| DDX60 | 13 | 5 | 0.012 |
| DHX8 | 10 | 2 | 0.005 |
| DLEC1 | 16 | 9 | 0.031 |
| DNAH2 | 23 | 14 | 0.011 |
| FHOD1 | 8 | 2 | 0.020 |
| HK3 | 7 | 2 | 0.040 |
| KALRN | 27 | 10 | 0.000093 |

TABLE 3-continued

| Gene | N (R) | N (NR) | p-value (Fisher's exact) |
| --- | --- | --- | --- |
| KIF21B | 15 | 9 | 0.049 |
| KIF5A | 11 | 5 | 0.036 |
| KRAS | 11 | 3 | 0.0095 |
| MCTP1 | 12 | 6 | 0.045 |
| MGAM | 33 | 26 | 0.022 |
| NARS2 | 6 | 0 | 0.0055 |
| ZNF253 | 10 | 4 | 0.047 |
| NF1 | 25 | 17 | 0.016 |
| *NR1H4* | *2* | *11* | *0.046* |
| PBRM1 | 10 | 4 | 0.047 |
| PKP1 | 7 | 2 | 0.040 |
| PLCB4 | 21 | 11 | 0.0065 |
| POLR2A | 10 | 4 | 0.047 |
| PREX2 | 25 | 19 | 0.042 |
| *RB1* | *1* | *10* | *0.026* |
| ROCK1 | 8 | 2 | 0.020 |
| SAFB2 | 9 | 3 | 0.032 |
| SERPINB3 | 11 | 5 | 0.036 |
| SPATA16 | 12 | 6 | 0.045 |
| STAB1 | 17 | 10 | 0.037 |
| TGM3 | 11 | 5 | 0.036 |
| TSC1 | 13 | 6 | 0.027 |
| TSPAN2 | 7 | 2 | 0.040 |
| ZNF207 | 6 | 1 | 0.044 |

*Genes in italics (i.e., NR1H4 and RB1) mutated more frequently in NR vs. R. Genes in plain text mutated more frequently in R vs. NR.
**Bolded genes (i.e., DHX8, KALRN, KRAS, NARS2, and PLCB4) have p < 0.01.

Figure 6:
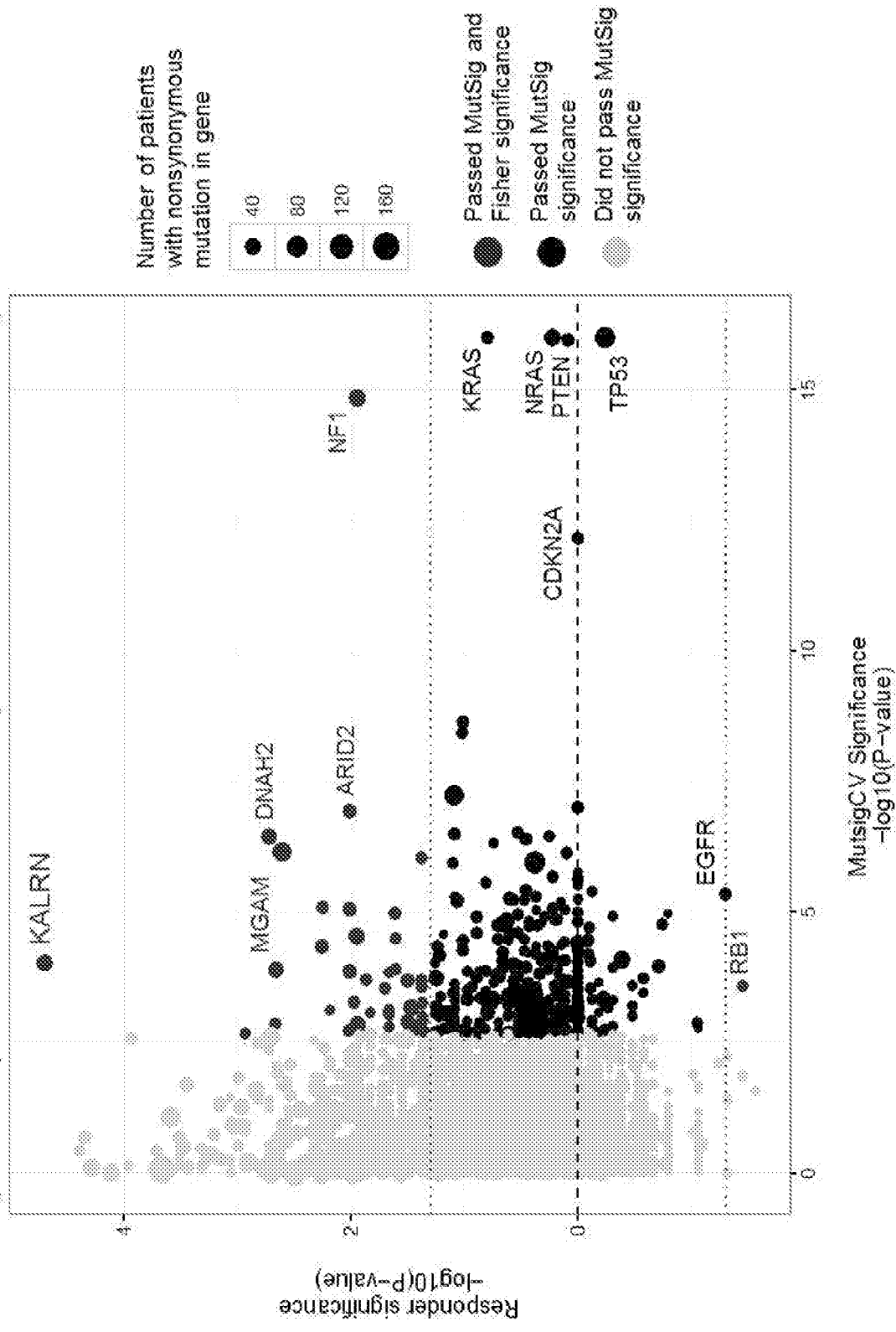
FIG. 6 shows genes significantly mutated in responders vs. non-responders or intermediate responders (such as those having intermediate clinical benefit).
Figure 7:
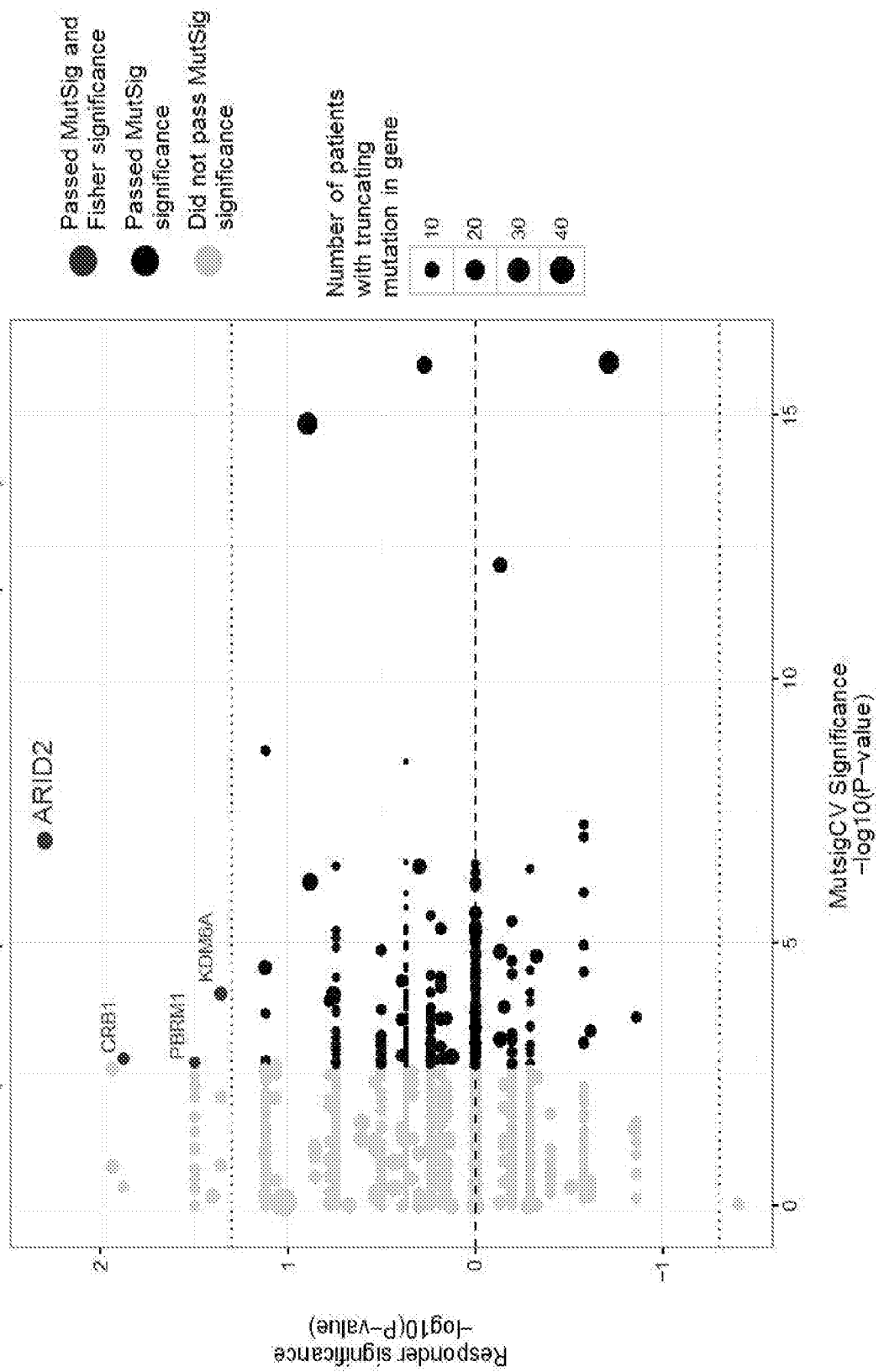
FIG. 7 shows genes significantly mutated (such as those having truncating muations) in responders vs. non-responders.
Figure 8:
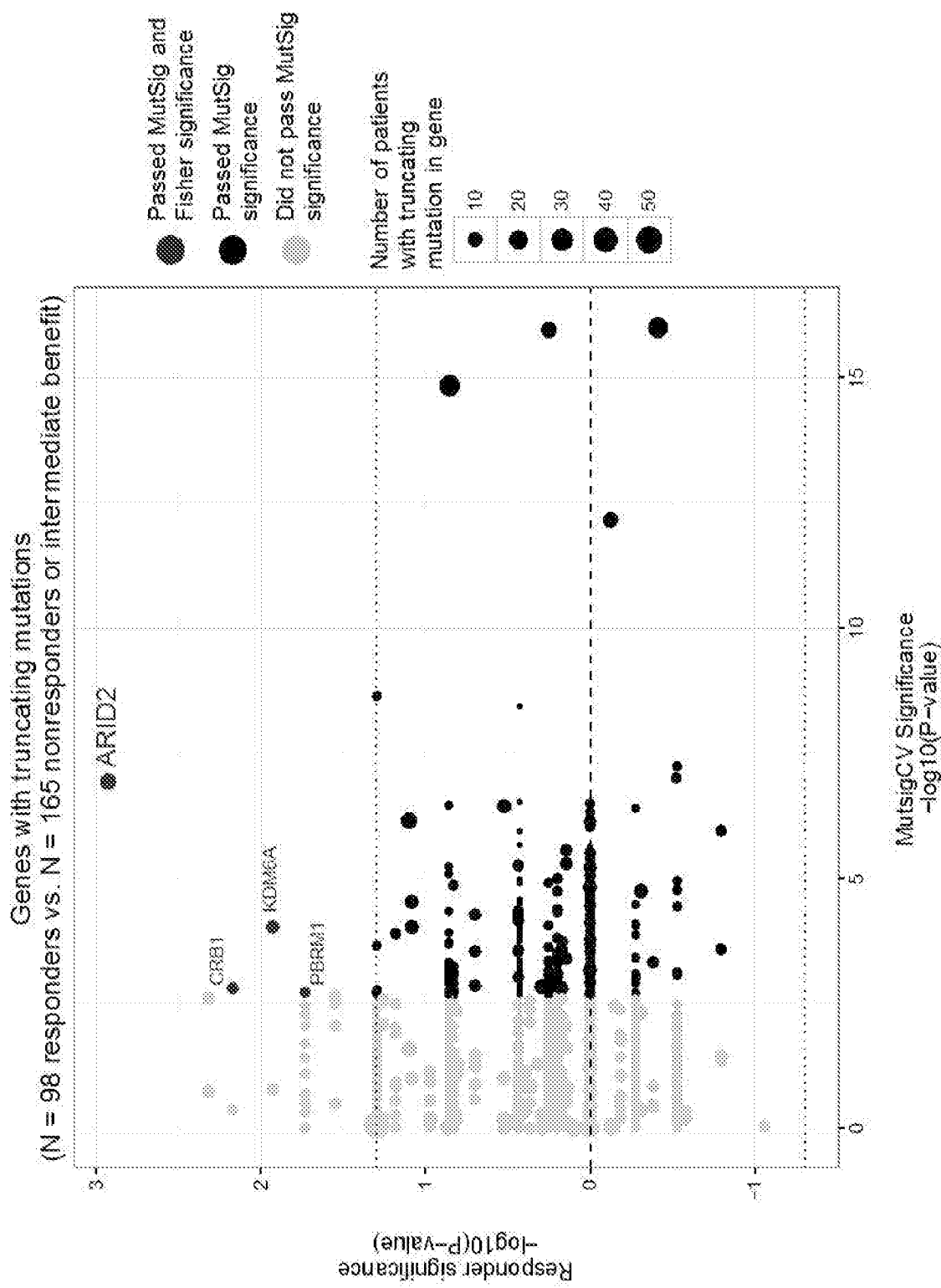
FIG. 8 shows genes significantly mutated (such as those having truncating muations) in responders vs. non-responders or intermediate responders (those having intermediate clinical benefit).

After limiting analyses to comparing patients with objective tumor response (CR, PR, or SD by RECIST vs. PD by RECIST) in non-melanoma cancer types, it was observed that a striking association exists between mutations in one or more SWI/SNF complex subunits and response to immune checkpoint therapy (Tables 4-5 and FIGS. 6-8).

For example, truncating alterations in PBRM1 and response to immune checkpoint therapy, driven by nonsense, frameshift, and splice site mutations in bladder cancer, lung cancer, and renal cell carcinoma (9/75 responders vs. 0/41 non-responders, p=0.026). Additionally, it was observed that ARID2 truncating mutations enriched in responders in melanoma across multiple clinical cohorts (6/68 responders vs. 2/96 non-responders), as well as in isolated cases in other tumor types (one frameshift deletion in lung cancer PR and one frameshift deletion in one SD RCC). Interestingly, the two ARID2 alterations occurring in non-responders occurred in patients receiving anti-CTLA4 therapies (rather than anti-PD1 therapies), though one patient with PR to anti-CTLA4 also had an ARID2 splice site mutation. Lastly, it was observed that mutations in SMARCA4 were associated with response in head and neck squamous cell carcinoma (3/6 responders vs. 0/9 non-responders, p=0.044, Fisher's exact test). Thus, alterations in the SWI/SNF pathway were found to be predictive of response to immune checkpoint therapy across cancer types.

TABLE 4

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat132-Tumor-SM-5VWJA | MEL-IPI_Pat132-TP-NB-SM-5VWJA-SM-5VWHR | ACTL6A | 86 | 3 | 179294461 | 179294461 | Missense_Mutation | + |
| MEL-IPI_Pat138-Tumor-SM-5VWJG | MEL-IPI_Pat138-TP-NB-SM-5VWJG-SM-5VWHX | ACTL6A | 86 | 3 | 179298455 | 179298455 | Missense_Mutation | + |
| Pt20 | Pt20 | ACTL6A | 86 | 3 | 179294018 | 179294018 | Missense_Mutation | − |
| CR04885 | CR04885 | ACTL6B | 51412 | 7 | 100244379 | 100244379 | Missense_Mutation | + |
| Lung-DFCI-11-104-009-Tumor-SM-5YS7O | Lung-DFCI-11-104-009-TM-NB-SM-5YS7O-SM-5YS7P | ACTL6B | 51412 | 7 | 100244451 | 100244451 | Missense_Mutation | + |
| MEL-IPI_Pat130-Tumor-SM-5X2R8 | MEL-IPI_Pat130-TP-NT-SM-5X2R8-SM-5X2RJ | ACTL6B | 51412 | 7 | 100247744 | 100247744 | Silent | − |
| MEL-IPI_Pat138-Tumor-SM-5VWJG | MEL-IPI_Pat138-TP-NB-SM-5VWJG-SM-5VWHX | ACTL6B | 51412 | 7 | 100240903 | 100240903 | Missense_Mutation | + |
| MEL-IPI_Pat139-Tumor-SM-5VWJH | MEL-IPI_Pat139-TP-NB-SM-5VWJH-SM-5VWHY | ACTL6B | 51412 | 7 | 100244908 | 100244908 | Splice_Site | − |
| MEL-IPI_Pat28-Tumor-SM-4DK1O | MEL-IPI_Pat28-TP-NB-SM-4DK1O-SM-4NFUU | ACTL6B | 51412 | 7 | 100244416 | 100244416 | Silent | − |
| MEL-IPI_Pat38-Tumor-SM-53U3Z | MEL-IPI_Pat38-TP-NT-SM-53U3Z-SM-53U5L | ACTL6B | 51412 | 7 | 100244877 | 100244877 | Silent | + |
| MEL-IPI_Pat38-Tumor-SM-53U3Z | MEL-IPI_Pat38-TP-NT-SM-53U3Z-SM-53U5L | ACTL6B | 51412 | 7 | 100244902 | 100244902 | Silent | + |
| PR4035 | PR4035 | ACTL6B | 51412 | 7 | 100253064 | 100253064 | Missense_Mutation | + |
| Pt14 | Pt14 | ACTL6B | 51412 | 7 | 100253200 | 100253200 | Missense_Mutation | + |
| Pt4 | Pt4 | ACTL6B | 51412 | 7 | 100246273 | 100246273 | Missense_Mutation | + |
| RH090935 | RH090935 | ACTL6B | 51412 | 7 | 100253478 | 100253478 | Missense_Mutation | ± |
| SD1494 | SD1494 | ACTL6B | 51412 | 7 | 100253045 | 100253045 | Splice_Site | ± |
| SU2C_Lung-SU2C-DFCI-LUAD-1011-Tumor-SM-AOL75 | SU2C_Lung-SU2C-DFCI-LUAD-1011-TM-NB-SM-AOL75-SM-A46NN | ACTL6B | 51412 | 7 | 100252740 | 100252740 | Missense_Mutation | − |
| AL4602 | AL4602 | ARID1A | 8289 | 1 | 27023633 | 27023633 | Missense_Mutation | ± |
| BLADDER-15330_CCPM_0700692-Tumor-SM-AVI11 | BLADDER-15330_CCPM_0700692-TM-NB-SM-AVI11-SM-AVHZM | ARID1A | 8289 | 1 | 27101612 | 27101612 | Frame_Shift_Del | − |
| BLCA-IM01-Tumor-SM-79XD9 | BLCA-IM01-TP-NB-SM-79XD9-SM-7AABJ | ARID1A | 8289 | 1 | 27057664 | 27057664 | Missense_Mutation | − |
| BLCA-IM01-Tumor-SM-79XD9 | BLCA-IM01-TP-NB-SM-79XD9-SM-7AABJ | ARID1A | 8289 | 1 | 27058092 | 27058097 | Splice_Site | − |
| BLCA-IM01-Tumor-SM-79XD9 | BLCA-IM01-TP-NB-SM-79XD9-SM-7AABJ | ARID1A | 8289 | 1 | 27057642 | 27057642 | Splice_Site | − |
| HNSCC-287-Tumor-SM-AXGEI | HNSCC-287-TP-NB-SM-AXGEI-SM-ADP7M | ARID1A | 8289 | 1 | 27100352 | 27100355 | Frame_Shift_Del | − |
| LO3793 | LO3793 | ARID1A | 8289 | 1 | 27105688 | 27105688 | Nonsense_Mutation | ± |
| LUAD-BS-13-F33496-Tumor-SM-9J2XU | LUAD-BS-13-F33496-TP-NB-SM-9J2XU-SM-9HBZX | ARID1A | 8289 | 1 | 27056342 | 27056343 | Frame_Shift_Del | ± |
| Lung-DFCI-11-104-009-Tumor-SM-5YS7O | Lung-DFCI-11-104-009-TM-NB-SM-5YS7O-SM-5YS7P | ARID1A | 8289 | 1 | 27106621 | 27106621 | Nonsense_Mutation | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat07-Tumor-SM-4DK13 | MEL-IPI_Pat07-TP-NB-SM-4DK13-SM-4NFU9 | ARID1A | 8289 | 1 | 27105918 | 27105918 | Silent | + |
| MEL-IPI_Pat11-Tumor-SM-4DK17 | MEL-IPI_Pat11-TP-NB-SM-4DK17-SM-4NFUD | ARID1A | 8289 | 1 | 27101642 | 27101642 | Missense_Mutation | − |
| MEL-IPI_Pat110-Tumor-SM-4CU6X | MEL-IPI_Pat110-TP-NT-SM-4CU6X-SM-4MGPO | ARID1A | 8289 | 1 | 27106693 | 27106693 | Missense_Mutation | − |
| MEL-IPI_Pat133-Tumor-SM-5VWJB | MEL-IPI_Pat133-TP-NB-SM-5VWJB-SM-5VWHS | ARID1A | 8289 | 1 | 27089607 | 27089607 | Missense_Mutation | − |
| MEL-IPI_Pat138-Tumor-SM-5VWJG | MEL-IPI_Pat138-TP-NB-SM-5VWJG-SM-5VWHX | ARID1A | 8289 | 1 | 27023487 | 27023487 | Missense_Mutation | + |
| MEL-IPI_Pat138-Tumor-SM-5VWJG | MEL-IPI_Pat138-TP-NB-SM-5VWJG-SM-5VWHX | ARID1A | 8289 | 1 | 27106461 | 27106461 | Silent | + |
| MEL-IPI_Pat138-Tumor-SM-5VWJG | MEL-IPI_Pat138-TP-NB-SM-5VWJG-SM-5VWHX | ARID1A | 8289 | 1 | 27058070 | 27058070 | Missense_Mutation | + |
| MEL-IPI_Pat159-Tumor-SM-5VWK2 | MEL-IPI_Pat159-TP-NB-SM-5VWK2-SM-5VWIJ | ARID1A | 8289 | 1 | 27087452 | 27087452 | Missense_Mutation | − |
| MEL-IPI_Pat163-Tumor-SM-5VWK6 | MEL-IPI_Pat163-TP-NB-SM-5VWK6-SM-5VWIN | ARID1A | 8289 | 1 | 27107176 | 27107176 | Missense_Mutation | − |
| MEL-IPI_Pat37-Tumor-SM-53U3Y | MEL-IPI_Pat37-TP-NB-SM-53U3Y-SM-4NFV4 | ARID1A | 8289 | 1 | 27101712 | 27101712 | Splice_Site | − |
| MEL-IPI_Pat37-Tumor-SM-53U3Y | MEL-IPI_Pat37-TP-NB-SM-53U3Y-SM-4NFV4 | ARID1A | 8289 | 1 | 27105837 | 27105837 | Silent | − |
| MEL-IPI_Pat38-Tumor-SM-53U3Z | MEL-IPI_Pat38-TP-NT-SM-53U3Z-SM-53U5L | ARID1A | 8289 | 1 | 27087393 | 27087393 | Missense_Mutation | + |
| MEL-IPI_Pat39-Tumor-SM-4DK1Z | MEL-IPI_Pat39-TP-NB-SM-4DK1Z-SM-4NFV6 | ARID1A | 8289 | 1 | 27057822 | 27057822 | Silent | + |
| MEL-IPI_Pat62-Tumor-SM-4DK2N | MEL-IPI_Pat62-TP-NB-SM-4DK2N-SM-4NFVT | ARID1A | 8289 | 1 | 27087494 | 27087494 | Missense_Mutation | − |
| MEL-IPI_Pat64-Tumor-SM-4DK2P | MEL-IPI_Pat64-TP-NB-SM-4DK2P-SM-4NFVV | ARID1A | 8289 | 1 | 27099940 | 27099940 | Missense_Mutation | − |
| MEL-IPI_Pat85-Tumor-SM-53U2Y | MEL-IPI_Pat85-TP-NB-SM-53U2Y-SM-4NFWH | ARID1A | 8289 | 1 | 27058033 | 27058033 | Nonsense_Mutation | − |
| PR11217 | PR11217 | ARID1A | 8289 | 1 | 27093053 | 27093053 | Missense_Mutation | + |
| PR4077 | PR4077 | ARID1A | 8289 | 1 | 27089494 | 27089494 | Missense_Mutation | + |
| Pt15 | Pt15 | ARID1A | 8289 | 1 | 27101090 | 27101090 | Intron | + |
| SU2C_Lung-SU2C-DFCI-LUAD-1017-Tumor-SM-AOL99 | SU2C_Lung-SU2C-DFCI-LUAD-1017-TM-NB-SM-AOL99-SM-A46NT | ARID1A | 8289 | 1 | 27101525 | 27101525 | Frame_Shift_Del | + |
| SU2C_Lung-SU2C-DFCI-LUAD-1017-Tumor-SM-AOL99 | SU2C_Lung-SU2C-DFCI-LUAD-1017-TM-NB-SM-AOL99-SM-A46NT | ARID1A | 8289 | 1 | 27106878 | 27106878 | Frame_Shift_Del | + |
| Y2087 | Y2087 | ARID1A | 8289 | 1 | 27023360 | 27023360 | Missense_Mutation | ± |
| ZA6965 | ZA6965 | ARID1A | 8289 | 1 | 27023690 | 27023690 | Missense_Mutation | + |
| BLCA-IM01-Tumor-SM-79XD9 | BLCA-IM01-TP-NB-SM-79XD9-SM-7AABJ | ARID1B | 57492 | 6 | 157100005 | 157100005 | Silent | − |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| HNSCC-239-Tumor-SM-AXGCS | HNSCC-239-TP-NB-SM-AXGCS-SM-ADP7K | ARID1B | 57492 | 6 | 157100005 | 157100005 | Silent | ± |
| HNSCC-243-Tumor-SM-CLFNS | HNSCC-243-TP-NB-SM-CLFNS-SM-AV34T | ARID1B | 57492 | 6 | 157100005 | 157100005 | Silent | − |
| LUAD-BS-11-R21845-Tumor-SM-9J2YH | LUAD-BS-11-R21845-TP-NT-SM-9J2YH-SM-9J2YI | ARID1B | 57492 | 6 | 157100005 | 157100005 | Silent | + |
| LUAD-BS-13-X14864-Tumor-SM-9J2XQ | LUAD-BS-13-X14864-TP-NB-SM-9J2XQ-SM-9HBZU | ARID1B | 57492 | 6 | 157528372 | 157528372 | Missense_Mutation | ± |
| LUAD-BS-14-G65174-Tumor-SM-9J2YF | LUAD-BS-14-G65174-TP-NT-SM-9J2YF-SM-9J2YG | ARID1B | 57492 | 6 | 157100005 | 157100005 | Silent | − |
| MEL-682321-Tumor-SM-CN21G | MEL-682321-TP-NB-SM-CN21G-SM-CJP7S | ARID1B | 57492 | 6 | 157099512 | 157099512 | Missense_Mutation | + |
| MEL-682321-Tumor-SM-CN21G | MEL-682321-TP-NB-SM-CN21G-SM-CJP7S | ARID1B | 57492 | 6 | 157099511 | 157099511 | Missense_Mutation | + |
| MEL-IPI_Pat132-Tumor-SM-5VWJA | MEL-IPI_Pat132-TP-NB-SM-5VWJA-SM-5VWHR | ARID1B | 57492 | 6 | 157517305 | 157517305 | Missense_Mutation | + |
| MEL-IPI_Pat138-Tumor-SM-5VWJG | MEL-IPI_Pat138-TP-NB-SM-5VWJG-SM-5VWHX | ARID1B | 57492 | 6 | 157522597 | 157522597 | Silent | + |
| MEL-IPI_Pat138-Tumor-SM-5VWJG | MEL-IPI_Pat138-TP-NB-SM-5VWJG-SM-5VWHX | ARID1B | 57492 | 6 | 157527479 | 157527479 | Missense_Mutation | + |
| MEL-IPI_Pat138-Tumor-SM-5VWJG | MEL-IPI_Pat138-TP-NB-SM-5VWJG-SM-5VWHX | ARID1B | 57492 | 6 | 157502265 | 157502265 | Silent | + |
| MEL-IPI_Pat138-Tumor-SM-5VWJG | MEL-IPI_Pat138-TP-NB-SM-5VWJG-SM-5VWHX | ARID1B | 57492 | 6 | 157511325 | 157511325 | Silent | + |
| MEL-IPI_Pat139-Tumor-SM-5VWJH | MEL-IPI_Pat139-TP-NB-SM-5VWJH-SM-5VWHY | ARID1B | 57492 | 6 | 157527627 | 157527627 | Silent | − |
| MEL-IPI_Pat139-Tumor-SM-5VWJH | MEL-IPI_Pat139-TP-NB-SM-5VWJH-SM-5VWHY | ARID1B | 57492 | 6 | 157505558 | 157505558 | Missense_Mutation | + |
| MEL-IPI_Pat174-Tumor-SM-5VOB4 | MEL-IPI_Pat174-TP-NB-SM-5VOB4-SM-5VWIY | ARID1B | 57492 | 6 | 157528667 | 157528667 | Missense_Mutation | + |
| MEL-IPI_Pat21-Tumor-SM-4DK1H | MEL-IPI_Pat21-TP-NT-SM-4DK1H-SM-53U5G | ARID1B | 57492 | 6 | 157522222 | 157522222 | Missense_Mutation | + |
| MEL-IPI_Pat39-Tumor-SM-4DK1Z | MEL-IPI_Pat39-TP-NB-SM-4DK1Z-SM-4NFV6 | ARID1B | 57492 | 6 | 157511303 | 157511303 | Missense_Mutation | + |
| MEL-IPI_Pat74-Tumor-SM-4DK2Z | MEL-IPI_Pat74-TP-NB-SM-4DK2Z-SM-4NFW6 | ARID1B | 57492 | 6 | 157100377 | 157100377 | Silent | − |
| MEL-IPI_Pat74-Tumor-SM-4DK2Z | MEL-IPI_Pat74-TP-NB-SM-4DK2Z-SM-4NFW6 | ARID1B | 57492 | 6 | 157100376 | 157100376 | Missense_Mutation | − |
| PR11217 | PR11217 | ARID1B | 57492 | 6 | 157522344 | 157522344 | Missense_Mutation | + |
| PR4092 | PR4092 | ARID1B | 57492 | 6 | 157521990 | 157521990 | Missense_Mutation | + |
| Pt8 | Pt8 | ARID1B | 57492 | 6 | 157222594 | 157222594 | Missense_Mutation | + |
| SA9755 | SA9755 | ARID1B | 57492 | 6 | 157522508 | 157522508 | Missense_Mutation | + |
| SD1494 | SD1494 | ARID1B | 57492 | 6 | 157522095 | 157522095 | Missense_Mutation | ± |
| SU2C_Lung-SU2C-DFCI-LUAD-1006-Tumor-SM-AOL5E | SU2C_Lung-SU2C-DFCI-LUAD-1006-TP-NB-SM-AOL5E-SM-A46NI | ARID1B | 57492 | 6 | 157100005 | 157100005 | Silent | − |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| SU2C_Lung-SU2C-DFCI-AOL75 | SU2C_Lung-SU2C-DFCI-LUAD-1011-TM-NB-SM-AOL75-SM-A46NN | ARID1B | 57492 | 6 | 157222621 | 157222621 | Missense_Mutation | – |
| Y2087 | Y2087 | ARID1B | 57492 | 6 | 157099481 | 157099481 | Missense_Mutation | ± |
| Case1-BaselineTumor | Case1-TP-NB-Zaretsky | ARID2 | 196528 | 12 | 46287234 | 46287234 | Missense_Mutation | + |
| Case3-BaselineTumor | Case3-TP-NB-Zaretsky | ARID2 | 196528 | 12 | 46243857 | 46243857 | Nonsense_Mutation | + |
| HNSCC-323-Tumor-SM-CK9WS | HNSCC-323-TP-NB-SM-CK9WS-SM-AV34N | ARID2 | 196528 | 12 | 46240638 | 46240638 | Splice_Site | + |
| LSD6819 | LSD6819 | ARID2 | 196528 | 12 | 46243857 | 46243857 | Nonsense_Mutation | + |
| LUAD-BS-08-013532-Tumor-SM-9J2Y1 | LUAD-BS-08-013532-TP-NT-SM-9J2Y1-SM-9J2Y2 | ARID2 | 196528 | 12 | 46245525 | 46245525 | Frame_Shift_Del | + |
| LUAD-BS-13-J60666-Tumor-SM-9J2YL | LUAD-BS-13-J60666-TP-NB-SM-9J2YL-SM-9HBZW | ARID2 | 196528 | 12 | 46246071 | 46246071 | Missense_Mutation | + |
| MEL-650366-Tumor-SM-CN221 | MEL-650366-TP-NB-SM-CN221-SM-CJP7U | ARID2 | 196528 | 12 | 46245857 | 46245857 | Silent | – |
| MEL-IPI_Pat100-Tumor-SM-53U2D | MEL-IPI_Pat100-TP-NT-SM-53U2D-SM-53U4M | ARID2 | 196528 | 12 | 46230641 | 46230641 | Missense_Mutation | – |
| MEL-IPI_Pat100-Tumor-SM-53U2D | MEL-IPI_Pat100-TP-NT-SM-53U2D-SM-53U4M | ARID2 | 196528 | 12 | 46242701 | 46242701 | Nonsense_Mutation | – |
| MEL-IPI_Pat103-Tumor-SM-4CU6Q | MEL-IPI_Pat103-TP-NT-SM-4CU6Q-SM-53U4P | ARID2 | 196528 | 12 | 46243514 | 46243514 | Missense_Mutation | + |
| MEL-IPI_Pat109-Tumor-SM-4CU6W | MEL-IPI_Pat109-TP-NT-SM-4CU6W-SM-4MGPN | ARID2 | 196528 | 12 | 46243825 | 46243825 | Missense_Mutation | – |
| MEL-IPI_Pat109-Tumor-SM-4CU6W | MEL-IPI_Pat109-TP-NT-SM-4CU6W-SM-4MGPN | ARID2 | 196528 | 12 | 46243824 | 46243824 | Missense_Mutation | – |
| MEL-IPI_Pat115-Tumor-SM-5X2QS | MEL-IPI_Pat115-TP-NT-SM-5X2QS-SM-5X2RA | ARID2 | 196528 | 12 | 46211474 | 46211474 | Missense_Mutation | – |
| MEL-IPI_Pat117-Tumor-SM-5X2QU | MEL-IPI_Pat117-TP-NT-SM-5X2QU-SM-5X2RC | ARID2 | 196528 | 12 | 46244997 | 46244997 | Nonsense_Mutation | + |
| MEL-IPI_Pat117-Tumor-SM-5X2QU | MEL-IPI_Pat117-TP-NT-SM-5X2QU-SM-5X2RC | ARID2 | 196528 | 12 | 46245843 | 46245843 | Nonsense_Mutation | + |
| MEL-IPI_Pat132-Tumor-SM-5VWJA | MEL-IPI_Pat132-TP-NB-SM-5VWJA-SM-5VWHR | ARID2 | 196528 | 12 | 46243530 | 46243530 | Missense_Mutation | + |
| MEL-IPI_Pat138-Tumor-SM-5VWJG | MEL-IPI_Pat138-TP-NB-SM-5VWJG-SM-5VWHX | ARID2 | 196528 | 12 | 46242749 | 46242749 | Missense_Mutation | + |
| MEL-IPI_Pat139-Tumor-SM-5VWJH | MEL-IPI_Pat139-TP-NB-SM-5VWJH-SM-5VWHY | ARID2 | 196528 | 12 | 46205217 | 46205217 | Missense_Mutation | – |
| MEL-IPI_Pat151-Tumor-SM-5VWJT | MEL-IPI_Pat151-TP-NB-SM-5VWJT-SM-5VWIB | ARID2 | 196528 | 12 | 46287240 | 46287240 | Missense_Mutation | – |
| MEL-IPI_Pat159-Tumor-SM-5VWK2 | MEL-IPI_Pat159-TP-NB-SM-5VWK2-SM-5VWIJ | ARID2 | 196528 | 12 | 46244889 | 46244889 | Nonsense_Mutation | – |
| MEL-IPI_Pat174-Tumor-SM-5VOB4 | MEL-IPI_Pat174-TP-NB-SM-5VOB4-SM-5VWIY | ARID2 | 196528 | 12 | 46215271 | 46215271 | Splice_Site | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat58-Tumor-SM-4DK2J | MEL-IPI_Pat58-TP-NB-SM-4DK2J-SM-4NFVP | ARID2 | 196528 | 12 | 46245648 | 46245648 | Missense_Mutation | − |
| MEL-IPI_Pat58-Tumor-SM-4DK2J | MEL-IPI_Pat58-TP-NB-SM-4DK2J-SM-4NFVP | ARID2 | 196528 | 12 | 46240672 | 46240672 | Missense_Mutation | − |
| MEL-IPI_Pat58-Tumor-SM-4DK2J | MEL-IPI_Pat58-TP-NB-SM-4DK2J-SM-4NFVP | ARID2 | 196528 | 12 | 46287428 | 46287428 | Missense_Mutation | − |
| MEL-IPI_Pat66-Tumor-SM-4DK2R | MEL-IPI_Pat66-TP-NB-SM-4DK2R-SM-4NFVX | ARID2 | 196528 | 12 | 46230691 | 46230691 | Missense_Mutation | + |
| PR11217 | PR11217 | ARID2 | 196528 | 12 | 46233249 | 46233249 | Nonsense_Mutation | + |
| PR11217 | PR11217 | ARID2 | 196528 | 12 | 46245639 | 46245639 | Nonsense_Mutation | + |
| PR4077 | PR4077 | ARID2 | 196528 | 12 | 46243857 | 46243857 | Nonsense_Mutation | + |
| PR4092 | PR4092 | ARID2 | 196528 | 12 | 46242619 | 46242619 | Splice_Site | + |
| Pt1 | Pt1 | ARID2 | 196528 | 12 | 46123846 | 46123846 | Missense_Mutation | − |
| Pt31 | Pt31 | ARID2 | 196528 | 12 | 46243467 | 46243467 | Missense_Mutation | − |
| Pt37 | Pt37 | ARID2 | 196528 | 12 | 46211600 | 46211600 | Frame_Shift_Del | + |
| SU2C_Lung-SU2C-DFCI-LUAD-1016-Tumor-SM-AOL8W | SU2C_Lung-SU2C-DFCI-LUAD-1016-TM-NB-SM-AOL8W-SM-A46NS | ARID2 | 196528 | 12 | 46244393 | 46244393 | Silent | ± |
| WA7899 | WA7899 | ARID2 | 196528 | 12 | 46244529 | 46244529 | Missense_Mutation | − |
| DM123062 | DM123062 | BRD7 | 29117 | 16 | 50384049 | 50384049 | Missense_Mutation | − |
| Lung-DFCI-11-104-009-Tumor-SM-5YS7O | Lung-DFCI-11-104-009-TM-NB-SM-5YS7O-SM-5YS7P | BRD7 | 29117 | 16 | 50388348 | 50388348 | Missense_Mutation | + |
| MEL-IPI_Pat03-Tumor-SM-4DJZY | MEL-IPI_Pat03-TP-NB-SM-4DJZY-SM-4NFU5 | BRD7 | 29117 | 16 | 50357497 | 50357497 | Splice_Site | − |
| MEL-IPI_Pat110-Tumor-SM-4CU6X | MEL-IPI_Pat110-TP-NT-SM-4CU6X-SM-4MGPO | BRD7 | 29117 | 16 | 50368748 | 50368748 | Missense_Mutation | − |
| MEL-IPI_Pat03-Tumor-SM-4DJZY | MEL-IPI_Pat03-TP-NB-SM-4DJZY-SM-4NFU5 | DPF1 | 8193 | 19 | 38706825 | 38706825 | Missense_Mutation | − |
| MEL-IPI_Pat132-Tumor-SM-5VWJA | MEL-IPI_Pat132-TP-NB-SM-5VWJA-SM-5VWHR | DPF1 | 8193 | 19 | 38709622 | 38709622 | Silent | + |
| MEL-IPI_Pat134-Tumor-SM-7A151 | MEL-IPI_Pat134-TP-NB-SM-7A151-SM-5VWHT | DPF1 | 8193 | 19 | 38709646 | 38709646 | Silent | − |
| MEL-IPI_Pat138-Tumor-SM-5VWJG | MEL-IPI_Pat138-TP-NB-SM-5VWJG-SM-5VWHX | DPF1 | 8193 | 19 | 38702995 | 38702995 | Silent | + |
| MEL-IPI_Pat138-Tumor-SM-5VWJG | MEL-IPI_Pat138-TP-NB-SM-5VWJG-SM-5VWHX | DPF1 | 8193 | 19 | 38704352 | 38704352 | Missense_Mutation | + |
| MEL-IPI_Pat74-Tumor-SM-4DK2Z | MEL-IPI_Pat74-TP-NB-SM-4DK2Z-SM-4NFW6 | DPF1 | 8193 | 19 | 38712998 | 38712998 | Splice_Site | − |
| Pt27 | Pt27 | DPF1 | 8193 | 19 | 38709621 | 38709621 | Missense_Mutation | + |
| LUAD-BS-12-R10269-Tumor-SM-9J2XO | LUAD-BS-12-R10269-TP-NB-SM-9J2XO-SM-9HBZT | DPF2 | 5977 | 11 | 65108997 | 65108997 | Silent | + |
| MEL-IPI_Pat132-Tumor-SM-5VWJA | MEL-IPI_Pat132-TP-NB-SM-5VWJA-SM-5VWHR | DPF2 | 5977 | 11 | 65107914 | 65107914 | Missense_Mutation | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat159-Tumor-SM-5VWK2 | MEL-IPI_Pat159-TP-NB-SM-5VWK2-SM-5VWIJ | DPF2 | 5977 | 11 | 65113741 | 65113741 | Intron | − |
| MEL-IPI_Pat32-Tumor-SM-53U3T | MEL-IPI_Pat32-TP-NT-SM-53U3T-SM-53U67 | DPF2 | 5977 | 11 | 65108462 | 65108462 | Silent | − |
| MEL-IPI_Pat38-Tumor-SM-53U3Z | MEL-IPI_Pat38-TP-NT-SM-53U3Z-SM-53U5L | DPF2 | 5977 | 11 | 65123565 | 65123565 | IGR | + |
| MEL-IPI_Pat58-Tumor-SM-4DK2J | MEL-IPI_Pat58-TP-NB-SM-4DK2J-SM-4NFVP | DPF2 | 5977 | 11 | 65113530 | 65113530 | Intron | − |
| MEL-IPI_Pat74-Tumor-SM-4DK2Z | MEL-IPI_Pat74-TP-NB-SM-4DK2Z-SM-4NFW6 | DPF2 | 5977 | 11 | 65113812 | 65113812 | Intron | − |
| Pt13 | Pt13 | DPF2 | 5977 | 11 | 65111304 | 65111304 | Intron | + |
| Pt14 | Pt14 | DPF2 | 5977 | 11 | 65109007 | 65109007 | Missense_Mutation | − |
| SU2C_Lung-SU2C-DFCI-LUAD-1011-TM-NB-SM-AOL75 | SU2CLung-SU2C-DFCI-LUAD-1011-TM-NB-SM-AOL75-SM-A46NN | DPF2 | 5977 | 11 | 65113251 | 65113251 | Intron | − |
| DFCI_MM_2-Tumor-SM-BZRJA | DFCI_MM_2-TP-NB-SM-BZRJA-SM-BZRJD | DPF3 | 8110 | 14 | 73137945 | 73137945 | Intron | + |
| DFCI_MM_2-Tumor-SM-BZRJA | DFCI_MM_2-TP-NB-SM-BZRJA-SM-BZRJD | DPF3 | 8110 | 14 | 73238507 | 73238507 | Missense_Mutation | + |
| FR9547 | FR9547 | DPF3 | 8110 | 14 | 73140993 | 73140993 | Missense_Mutation | + |
| Lung-DFCI-11-104-009-Tumor-SM-5YS7O | Lung-DFCI-11-104-009-TM-NB-SM-5YS7O-SM-5YS7P | DPF3 | 8110 | 14 | 73137964 | 73137964 | Intron | + |
| MEL-IPI_Pat110-Tumor-SM-4CU6X | MEL-IPI_Pat110-TP-NT-SM-4CU6X-SM-4MGPO | DPF3 | 8110 | 14 | 73137905 | 73137905 | Intron | − |
| MEL-IPI_Pat110-Tumor-SM-4CU6X | MEL-IPI_Pat110-TP-NT-SM-4CU6X-SM-4MGPO | DPF3 | 8110 | 14 | 73137904 | 73137904 | Intron | − |
| MEL-IPI_Pat139-Tumor-SM-5VWJH | MEL-IPI_Pat139-TP-NB-SM-5VWJH-SM-5VWHY | DPF3 | 8110 | 14 | 73138006 | 73138006 | Intron | − |
| MEL-IPI_Pat139-Tumor-SM-5VWJH | MEL-IPI_Pat139-TP-NB-SM-5VWJH-SM-5VWHY | DPF3 | 8110 | 14 | 73138005 | 73138005 | Intron | − |
| MEL-IPI_Pat16-Tumor-SM-53U3E | MEL-IPI_Pat16-TP-NT-SM-53U3E-SM-53U5B | DPF3 | 8110 | 14 | 73220050 | 73220050 | Missense_Mutation | − |
| MEL-IPI_Pat21-Tumor-SM-4DK1H | MEL-IPI_Pat21-TP-NT-SM-4DK1H-SM-53U5G | DPF3 | 8110 | 14 | 73190370 | 73190370 | Missense_Mutation | + |
| SA9755 | SA9755 | DPF3 | 8110 | 14 | 73190391 | 73190391 | Missense_Mutation | + |
| BLCA-IM07-Tumor-SM-79XDD | BLCA-IM07-TP-NB-SM-79XDD-SM-7AABP | PBRM1 | 55193 | 3 | 52621431 | 52621431 | Splice_Site | + |
| CR04885 | CR04885 | PBRM1 | 55193 | 3 | 52597336 | 52597336 | Missense_Mutation | + |
| M4945 | M4945 | PBRM1 | 55193 | 3 | 52696148 | 52696148 | Missense_Mutation | + |
| MA7027 | MA7027 | PBRM1 | 55193 | 3 | 52598231 | 52598231 | Missense_Mutation | − |
| MEL-IPI_Pat103-Tumor-SM-4CU6Q | MEL-IPI_Pat103-TP-NT-SM-4CU6Q-SM-53U4P | PBRM1 | 55193 | 3 | 52620592 | 52620592 | Missense_Mutation | + |
| MEL-IPI_Pat103-Tumor-SM-4CU6Q | MEL-IPI_Pat103-TP-NT-SM-4CU6Q-SM-53U4P | PBRM1 | 55193 | 3 | 52620593 | 52620593 | Missense_Mutation | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat118-Tumor-SM-5X2QV | MEL-IPI_Pat118-TP-NT-SM-5X2QV-SM-4X2RD | PBRM1 | 55193 | 3 | 52692325 | 52692325 | Missense_Mutation | − |
| MEL-IPI_Pat138-Tumor-SM-5VWJG | MEL-IPI_Pat138-TP-NB-SM-5VWJG-SM-5VWHX | PBRM1 | 55193 | 3 | 52595959 | 52595959 | Missense_Mutation | + |
| MEL-IPI_Pat151-Tumor-SM-5VWJT | MEL-IPI_Pat151-TP-NB-SM-5VWJT-SM-5VWIB | PBRM1 | 55193 | 3 | 52643530 | 52643530 | Missense_Mutation | − |
| MEL-IPI_Pat38-Tumor-SM-53U3Z | MEL-IPI_Pat38-TP-NT-SM-53U3Z-SM-53U5L | PBRM1 | 55193 | 3 | 52643692 | 52643692 | Missense_Mutation | + |
| MEL-IPI_Pat70-Tumor-SM-4DK2V | MEL-IPI_Pat70-TP-NB-SM-4DK2V-SM-4NFW2 | PBRM1 | 55193 | 3 | 52584527 | 52584527 | Missense_Mutation | − |
| MEL-IPI_Pat79-Tumor-SM-53U2S | MEL-IPI_Pat79-TP-NB-SM-53U2S-SM-4NFWB | PBRM1 | 55193 | 3 | 52621315 | 52621315 | Intron | + |
| MEL-IPI_Pat88-Tumor-SM-4DK3E | MEL-IPI_Pat88-TP-NT-SM-4DK3E-SM-53U4C | PBRM1 | 55193 | 3 | 52668815 | 52668815 | Silent | + |
| MEL-IPI_Pat88-Tumor-SM-4DK3E | MEL-IPI_Pat88-TP-NT-SM-4DK3E-SM-53U4C | PBRM1 | 55193 | 3 | 52668765 | 52668765 | Missense_Mutation | + |
| PR4035 | PR4035 | PBRM1 | 55193 | 3 | 52643768 | 52643768 | Nonsense_Mutation | + |
| Pt13 | Pt13 | PBRM1 | 55193 | 3 | 52643768 | 52643768 | Nonsense_Mutation | + |
| SU2C_Lung-SU2C-DFCI-LUAD-1017-Tumor-SM-AOL99 | SU2C_Lung-SU2C-DFCI-LUAD-1017-TM-NB-SM-AOL99-SM-A46NT | PBRM1 | 55193 | 3 | 52651406 | 52651406 | Nonsense_Mutation | + |
| MEL-IPI_Pat110-Tumor-SM-4CU6X | MEL-IPI_Pat110-TP-NT-SM-4CU6X-SM-4MGPO | PHF10 | 55274 | 6 | 170112483 | 170112483 | Splice_Site | − |
| MEL-IPI_Pat138-Tumor-SM-5VWJG | MEL-IPI_Pat138-TP-NB-SM-5VWJG-SM-5VWHX | PHF10 | 55274 | 6 | 170116103 | 170116103 | Missense_Mutation | + |
| MEL-IPI_Pat58-Tumor-SM-4DK2J | MEL-IPI_Pat58-TP-NB-SM-4DK2J-SM-4NFVP | PHF10 | 55274 | 6 | 170117919 | 170117919 | Splice_Site | − |
| Pt1 | Pt1 | PHF10 | 55274 | 6 | 170112579 | 170112579 | Missense_Mutation | − |
| Pt2 | Pt2 | PHF10 | 55274 | 6 | 170116131 | 170116131 | Missense_Mutation | + |
| SD1494 | SD1494 | PHF10 | 55274 | 6 | 170117924 | 170117924 | Missense_Mutation | ± |
| BLCA-IM10-Tumor-SM-79XDG | BLCA-IM10-TP-NB-SM-79XDG-SM-9QSPX | SMARCA2 | 6595 | 9 | 2181573 | 2181573 | Missense_Mutation | + |
| BLCA-IM11-Tumor-SM-79XDH | BLCA-IM11-TP-NT-SM-79XDH-SM-79XDI | SMARCA2 | 6595 | 9 | 2033008 | 2033008 | Missense_Mutation | + |
| LSD0167 | LSD0167 | SMARCA2 | 6595 | 9 | 2161819 | 2161819 | Missense_Mutation | + |
| MEL-IPI_Pat132-Tumor-SM-5VWJA | MEL-IPI_Pat132-TP-NB-SM-5VWJA-SM-5VWHR | SMARCA2 | 6595 | 9 | 2039901 | 2039901 | Splice_Site | + |
| MEL-IPI_Pat132-Tumor-SM-5VWJA | MEL-IPI_Pat132-TP-NB-SM-5VWJA-SM-5VWHR | SMARCA2 | 6595 | 9 | 2186134 | 2186134 | Silent | + |
| MEL-IPI_Pat138-Tumor-SM-5VWJG | MEL-IPI_Pat138-TP-NB-SM-5VWJG-SM-5VWHX | SMARCA2 | 6595 | 9 | 2056722 | 2056722 | Silent | + |
| MEL-IPI_Pat15-Tumor-SM-4DK1B | MEL-IPI_Pat15-TP-NB-SM-4DK1B-SM-4NFUH | SMARCA2 | 6595 | 9 | 2070473 | 2070473 | Splice_Site | − |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat21-Tumor-SM-4DK1H | MEL-IPI_Pat21-TP-NT-SM-4DK1H-SM-53U5G | SMARCA2 | 6595 | 9 | 2161845 | 2161845 | Missense_Mutation | + |
| MEL-IPI_Pat38-Tumor-SM-53U3Z | MEL-IPI_Pat38-TP-NT-SM-53U3Z-SM-53U5L | SMARCA2 | 6595 | 9 | 2039623 | 2039623 | Silent | + |
| MEL-IPI_Pat90-Tumor-SM-4DK3G | MEL-IPI_Pat90-TP-NB-SM-4DK3G-SM-4NFWM | SMARCA2 | 6595 | 9 | 2186142 | 2186142 | Missense_Mutation | + |
| PR4092 | PR4092 | SMARCA2 | 6595 | 9 | 2161836 | 2161836 | Missense_Mutation | + |
| Pt31 | Pt31 | SMARCA2 | 6595 | 9 | 2104046 | 2104046 | Missense_Mutation | – |
| RH090935 | RH090935 | SMARCA2 | 6595 | 9 | 2123911 | 2123911 | Missense_Mutation | + |
| SD2056 | SD2056 | SMARCA2 | 6595 | 9 | 2077654 | 2077654 | Missense_Mutation | ± |
| Y2087 | Y2087 | SMARCA2 | 6595 | 9 | 2047355 | 2047355 | Missense_Mutation | + |
| BLCA-IM07-Tumor-SM-79XDD | BLCA-IM07-TP-NB-SM-79XDD-SM-7AABP | SMARCA4 | 6597 | 19 | 11134267 | 11134267 | Missense_Mutation | + |
| BLCA-IM09-Tumor-SM-79XDF | BLCA-IM09-TP-NB-SM-79XDF-SM-7AABN | SMARCA4 | 6597 | 19 | 11097617 | 11097617 | Missense_Mutation | + |
| FR9547 | FR9547 | SMARCA4 | 6597 | 19 | 11136975 | 11136975 | Splice_Site | + |
| HNSCC-186-Tumor-SM-AXGDN | HNSCC-186-TP-NB-SM-AXGDN-SM-ADP7L | SMARCA4 | 6597 | 19 | 11144853 | 11144853 | 3UTR | + |
| HNSCC-186-Tumor-SM-AXGDN | HNSCC-186-TP-NB-SM-AXGDN-SM-ADP7L | SMARCA4 | 6597 | 19 | 11144853 | 11144853 | 3UTR | + |
| HNSCC-258-Tumor-SM-AXGAI | HNSCC-258-TP-NB-SM-AXGAI-SM-ADP7G | SMARCA4 | 6597 | 19 | 11170556 | 11170556 | Missense_Mutation | + |
| HNSCC-323-Tumor-SM-CK9WS | HNSCC-323-TP-NB-SM-CK9WS-SM-AV34N | SMARCA4 | 6597 | 19 | 11096069 | 11096069 | Nonsense_Mutation | + |
| LUAD-BS-13-J60666-Tumor-SM-9J2YL | LUAD-BS-13-J60666-TP-NB-SM-9J2YL-SM-9HBZW | SMARCA4 | 6597 | 19 | 11132428 | 11132438 | Missense_Mutation | + |
| LUAD-BS-14-G65174-Tumor-SM-9J2YF | LUAD-BS-14-G65174-TP-NT-SM-9J2YF-SM-9J2YG | SMARCA4 | 6597 | 19 | 11145805 | 11145805 | 3UTR | – |
| M4945 | M4945 | SMARCA4 | 6597 | 19 | 11144072 | 11144072 | IGR | + |
| MA7027 | MA7027 | SMARCA4 | 6597 | 19 | 11134207 | 11134207 | Missense_Mutation | – |
| MEL-IPI_Pat08-Tumor-SM-4DK14 | MEL-IPI_Pat08-TP-NB-SM-4DK14-SM-4NFUA | SMARCA4 | 6597 | 19 | 11121151 | 11121151 | Missense_Mutation | – |
| MEL-IPI_Pat110-Tumor-SM-4CU6X | MEL-IPI_Pat110-TP-NT-SM-4CU6X-SM-4MGPO | SMARCA4 | 6597 | 19 | 11096986 | 11096986 | Silent | – |
| MEL-IPI_Pat110-Tumor-SM-4CU6X | MEL-IPI_Pat110-TP-NT-SM-4CU6X-SM-4MGPO | SMARCA4 | 6597 | 19 | 11134230 | 11134230 | Missense_Mutation | – |
| MEL-IPI_Pat132-Tumor-SM-5VWJA | MEL-IPI_Pat132-TP-NB-SM-5VWJA-SM-5VWHR | SMARCA4 | 6597 | 19 | 11144106 | 11144106 | IGR | + |
| MEL-IPI_Pat138-Tumor-SM-5VWJG | MEL-IPI_Pat138-TP-NB-SM-5VWJG-SM-5VWHX | SMARCA4 | 6597 | 19 | 11144028 | 11144028 | IGR | + |
| MEL-IPI_Pat139-Tumor-SM-5VWJH | MEL-IPI_Pat139-TP-NB-SM-5VWJH-SM-5VWHY | SMARCA4 | 6597 | 19 | 11136986 | 11136986 | Missense_Mutation | – |
| MEL-IPI_Pat16-Tumor-SM-53U3E | MEL-IPI_Pat16-TP-NT-SM-53U3E-SM-53U5B | SMARCA4 | 6597 | 19 | 11141561 | 11141561 | IGR | – |
| MEL-IPI_Pat19-Tumor-SM-4DK1F | MEL-IPI_Pat19-TP-NB-SM-4DK1F-SM-4NFUL | SMARCA4 | 6597 | 19 | 11144856 | 11144856 | 3UTR | – |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat28-Tumor-SM-4DK1O | MEL-IPI_Pat28-TP-NB-SM-4DK1O-SM-4NFUU | SMARCA4 | 6597 | 19 | 11137018 | 11137018 | Nonsense_Mutation | − |
| MEL-IPI_Pat49-Tumor-SM-4DK2A | MEL-IPI_Pat49-TP-NT-SM-4DK2A-SM-53U5W | SMARCA4 | 6597 | 19 | 11121110 | 11121110 | Missense_Mutation | ± |
| MEL-IPI_Pat52-Tumor-SM-4DK2D | MEL-IPI_Pat52-TP-NT-SM-4DK2D-SM-53U5Z | SMARCA4 | 6597 | 19 | 11097614 | 11097614 | Missense_Mutation | − |
| MEL-IPI_Pat54-Tumor-SM-4DK2F | MEL-IPI_Pat54-TP-NB-SM-4DK2F-SM-4NFVL | SMARCA4 | 6597 | 19 | 11100047 | 11100047 | Silent | − |
| MEL-IPI_Pat58-Tumor-SM-4DK2J | MEL-IPI_Pat58-TP-NB-SM-4DK2J-SM-4NFVP | SMARCA4 | 6597 | 19 | 11098595 | 11098595 | Silent | − |
| Pt31 | Pt31 | SMARCA4 | 6597 | 19 | 11170804 | 11170804 | Nonsense_Mutation | − |
| SA9755 | SA9755 | SMARCA4 | 6597 | 19 | 11123685 | 11123685 | Missense_Mutation | + |
| SD1494 | SD1494 | SMARCA4 | 6597 | 19 | 11118614 | 11118614 | Missense_Mutation | ± |
| HNSCC-181-Tumor-SM-CK9X1 | HNSCC-181-TP-NB-SM-CK9X1-AV34P | SMARCB1 | 6598 | 22 | 24129440 | 24129440 | Silent | − |
| MEL-IPI_Pat110-Tumor-SM-4CU6X | MEL-IPI_Pat110-TP-NT-SM-4CU6X-SM-4MGPO | SMARCB1 | 6598 | 22 | 24143148 | 24143148 | Intron | − |
| MEL-IPI_Pat110-Tumor-SM-4CU6X | MEL-IPI_Pat110-TP-NT-SM-4CU6X-SM-4MGPO | SMARCB1 | 6598 | 22 | 24143149 | 24143149 | Intron | − |
| MEL-IPI_Pat130-Tumor-SM-5X2R8 | MEL-IPI_Pat130-TP-NT-SM-5X2R8-SM-5X2RJ | SMARCB1 | 6598 | 22 | 24143281 | 24143281 | Intron | − |
| MEL-IPI_Pat62-Tumor-SM-4DK2N | MEL-IPI_Pat62-TP-NB-SM-4DK2N-SM-4NFVT | SMARCB1 | 6598 | 22 | 24145537 | 24145537 | Silent | − |
| Pt2 | Pt2 | SMARCB1 | 6598 | 22 | 24133958 | 24133958 | Missense_Mutation | + |
| Lung-DFCI-11-104-009-Tumor-SM-5YS7O | Lung-DFCI-11-104-009-TM-NB-SM-5YS7O-SM-5YS7P | SMARCC1 | 6599 | 3 | 47823230 | 47823230 | Missense_Mutation | + |
| MEL-IPI_Pat03-Tumor-SM-4DJZY | MEL-IPI_Pat03-TP-NB-SM-4DJZY-SM-4NFU5 | SMARCC1 | 6599 | 3 | 47680267 | 47680267 | Missense_Mutation | − |
| MEL-IPI_Pat03-Tumor-SM-4DJZY | MEL-IPI_Pat03-TP-NB-SM-4DJZY-SM-4NFU5 | SMARCC1 | 6599 | 3 | 47787455 | 47787455 | Missense_Mutation | − |
| MEL-IPI_Pat08-Tumor-SM-4DK14 | MEL-IPI_Pat08-TP-NB-SM-4DK14-SM-4NFUA | SMARCC1 | 6599 | 3 | 47777539 | 47777539 | Silent | − |
| MEL-IPI_Pat110-Tumor-SM-4CU6X | MEL-IPI_Pat110-TP-NT-SM-4CU6X-SM-4MGPO | SMARCC1 | 6599 | 3 | 47632172 | 47632172 | Silent | − |
| MEL-IPI_Pat151-Tumor-SM-5VWJT | MEL-IPI_Pat151-TP-NB-SM-5VWJT-SM-5VWIB | SMARCC1 | 6599 | 3 | 47787430 | 47787430 | Silent | − |
| MEL-IPI_Pat28-Tumor-SM-4DK1O | MEL-IPI_Pat28-TP-NB-SM-4DK1O-SM-4NFUU | SMARCC1 | 6599 | 3 | 47742863 | 47742863 | Missense_Mutation | − |
| MEL-IPI_Pat58-Tumor-SM-4DK2J | MEL-IPI_Pat58-TP-NB-SM-4DK2J-SM-4NFVP | SMARCC1 | 6599 | 3 | 47651680 | 47651680 | Silent | − |
| MEL-IPI_Pat58-Tumor-SM-4DK2J | MEL-IPI_Pat58-TP-NB-SM-4DK2J-SM-4NFVP | SMARCC1 | 6599 | 3 | 47770567 | 47770567 | Silent | − |
| Pt4 | Pt4 | SMARCC1 | 6599 | 3 | 47629788 | 47629788 | Missense_Mutation | + |
| CR04885 | CR04885 | SMARCC2 | 6601 | 12 | 56565627 | 56565627 | Missense_Mutation | + |
| MEL-IPI_Pat138-Tumor-SM-5VWJG | MEL-IPI_Pat138-TP-NB-SM-5VWJG-SM-5VWHX | SMARCC2 | 6601 | 12 | 56558459 | 56558459 | Missense_Mutation | + |
| MEL-IPI_Pat139-Tumor-SM-5VWJH | MEL-IPI_Pat139-TP-NB-SM-5VWJH-5VWHY | SMARCC2 | 6601 | 12 | 56558475 | 56558475 | Missense_Mutation | − |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat27-Tumor-SM-4DK1N | MEL-IPI_Pat27-TP-NB-SM-4DK1N-SM-4NFUT | SMARCC2 | 6601 | 12 | 56578857 | 56578857 | Missense_Mutation | − |
| MEL-IPI_Pat32-Tumor-SM-53U3T | MEL-IPI_Pat32-TP-NT-SM-53U3T-SM-53U67 | SMARCC2 | 6601 | 12 | 56572223 | 56572223 | Silent | − |
| MEL-IPI_Pat58-Tumor-SM-4DK2J | MEL-IPI_Pat58-TP-NB-SM-4DK2J-SM-4NFVP | SMARCC2 | 6601 | 12 | 56563668 | 56563668 | Missense_Mutation | − |
| MEL-IPI_Pat64-Tumor-SM-4DK2P | MEL-IPI_Pat64-TP-NB-SM-4DK2P-SM-4NFVV | SMARCC2 | 6601 | 12 | 5656327 | 56563230 | Intron | − |
| MEL-IPI_Pat71-Tumor-SM-4DK2W | MEL-IPI_Pat71-TP-NB-SM-4DK2W-SM-4NFW3 | SMARCC2 | 6601 | 12 | 56566475 | 56566475 | Missense_Mutation | − |
| MEL-IPI_Pat77-Tumor-SM-4DK33 | MEL-IPI_Pat77-TP-NT-SM-4DK33-SM-53U63 | SMARCC2 | 6601 | 12 | 56575309 | 56575309 | Missense_Mutation | + |
| MEL-IPI_Pat77-Tumor-SM-4DK33 | MEL-IPI_Pat77-TP-NT-SM-4DK33-SM-53U63 | SMARCC2 | 6601 | 12 | 56575308 | 56575308 | Missense_Mutation | + |
| MEL-IPI_Pat62-Tumor-SM-4DK2N | MEL-IPI_Pat62-TP-NB-SM-4DK2N-SM-4NFVT | SMARCD1 | 6602 | 12 | 50480624 | 50480624 | Missense_Mutation | − |
| Pt37 | Pt37 | SMARCD1 | 6602 | 12 | 50484135 | 50484135 | Nonsense_Mutation | + |
| LUAD-BS-13-J60666-Tumor-SM-9J2YL | LUAD-BS-13-J60666-TP-NB-SM-9J2YL-SM-9HBZW | SMARCD2 | 6603 | 17 | 61912836 | 61912836 | Missense_Mutation | + |
| MEL-IPI_Pat119-Tumor-SM-7459N | MEL-IPI_Pat119-TP-NT-SM-7459N-SM-7459Q | SMARCD2 | 6603 | 17 | 61914856 | 61914856 | Nonsense_Mutation | − |
| MEL-IPI_Pat119-Tumor-SM-7459N | MEL-IPI_Pat119-TP-NT-SM-7459N-SM-7459Q | SMARCD2 | 6603 | 17 | 61914857 | 61914857 | Silent | − |
| MEL-IPI_Pat151-Tumor-SM-5VWJT | MEL-IPI_Pat151-TP-NB-SM-5VWJT-SM-5VWIB | SMARCD2 | 6603 | 17 | 61912922 | 61912922 | Silent | − |
| MEL-IPI_Pat21-Tumor-SM-4DK1H | MEL-IPI_Pat21-TP-NT-SM-4DK1H-SM-53U5G | SMARCD2 | 6603 | 17 | 61911039 | 61911039 | Missense_Mutation | + |
| MEL-IPI_Pat38-Tumor-SM-53U3Z | MEL-IPI_Pat38-TP-NT-SM-53U3Z-SM-53U5L | SMARCD2 | 6603 | 17 | 61914827 | 61914827 | Silent | + |
| Case3-Baseline Tumor | Case3-TP-NB-Zaretsky | SMARCD3 | 6604 | 7 | 150939235 | 150939235 | Silent | + |
| MEL-IPI_Pat11-Tumor-SM-4DK17 | MEL-IPI_Pat11-TP-NB-SM-4DK17-SM-4NFUD | SMARCD3 | 6604 | 7 | 150939045 | 150939045 | Missense_Mutation | − |
| BLADDER-15330_CCPM_0700694-Tumor-SM-AVI16 | BLADDER-15330_CCPM_0700694-TM-NB-SM-AVI16-SM-AVHZK | SMARCE1 | 6605 | 17 | 38793628 | 38793632 | Intron | + |
| MEL-IPI_Pat123-Tumor-SM-5X2R1 | MEL-IPI_Pat123-TP-NB-SM-5X2R1-SM-5VWHL | SMARCE1 | 6605 | 17 | 38787856 | 38787856 | Silent | + |
| MEL-IPI_Pat132-Tumor-SM-5VWJA | MEL-IPI_Pat132-TP-NB-SM-5VWJA-SM-5VWHR | SMARCE1 | 6605 | 17 | 38788513 | 38788513 | Silent | + |
| MEL-IPI_Pat138-Tumor-SM-5VWJG | MEL-IPI_Pat138-TP-NB-SM-5VWJG-SM-5VWHX | SMARCE1 | 6605 | 17 | 38787103 | 38787103 | Missense_Mutation | + |
| MEL-IPI_Pat138-Tumor-SM-5VWJG | MEL-IPI_Pat138-TP-NB-SM-5VWJG-SM-5VWHX | SMARCE1 | 6605 | 17 | 38785098 | 38785098 | Missense_Mutation | + |
| MEL-IPI_Pat70-Tumor-SM-4DK2V | MEL-IPI_Pat70-TP-NB-SM-4DK2V-SM-4NFW2 | SMARCE1 | 6605 | 17 | 38792665 | 38792665 | Silent | − |

All samples in Table 4 were from broad.mit.edu with NCBI-build no. of 37 and can be further identified based on the following information: ## Oncotator v1.2.7.0|Flat File Reference hg19|GENCODE v19|UniProt_AAxform 2011_09|ClinVar 12.03.20|ESP 6500SI-V2|0RegAnno UCSC Track|dbSNP build 134| CCLE_By_GP 09292010| COSMIC v62_291112|1000Genome phase1|UniProt_AA 2011_09|dbNSFP v2.4|ESP 6500SI-V2|COSMIC_ FusionGenes v62_291112|gencode_xref_refseq metadata_v19|CCLE_By_Gene 09292010|ACHILLES_ Lineage_Results 110303|CGC full_2012-03-15|UniProt 2011_09|HumanDNARepairGenes 20110905|HGNC Nov2013|COSMIC_Tissue 291112|Familial_Cancer_Genes 20110905|TUMORScape 20100104|Ensembl ICGC MUCOPA|TCGAScape 110405|MutSig Published Results 20110905.

Figure 10:
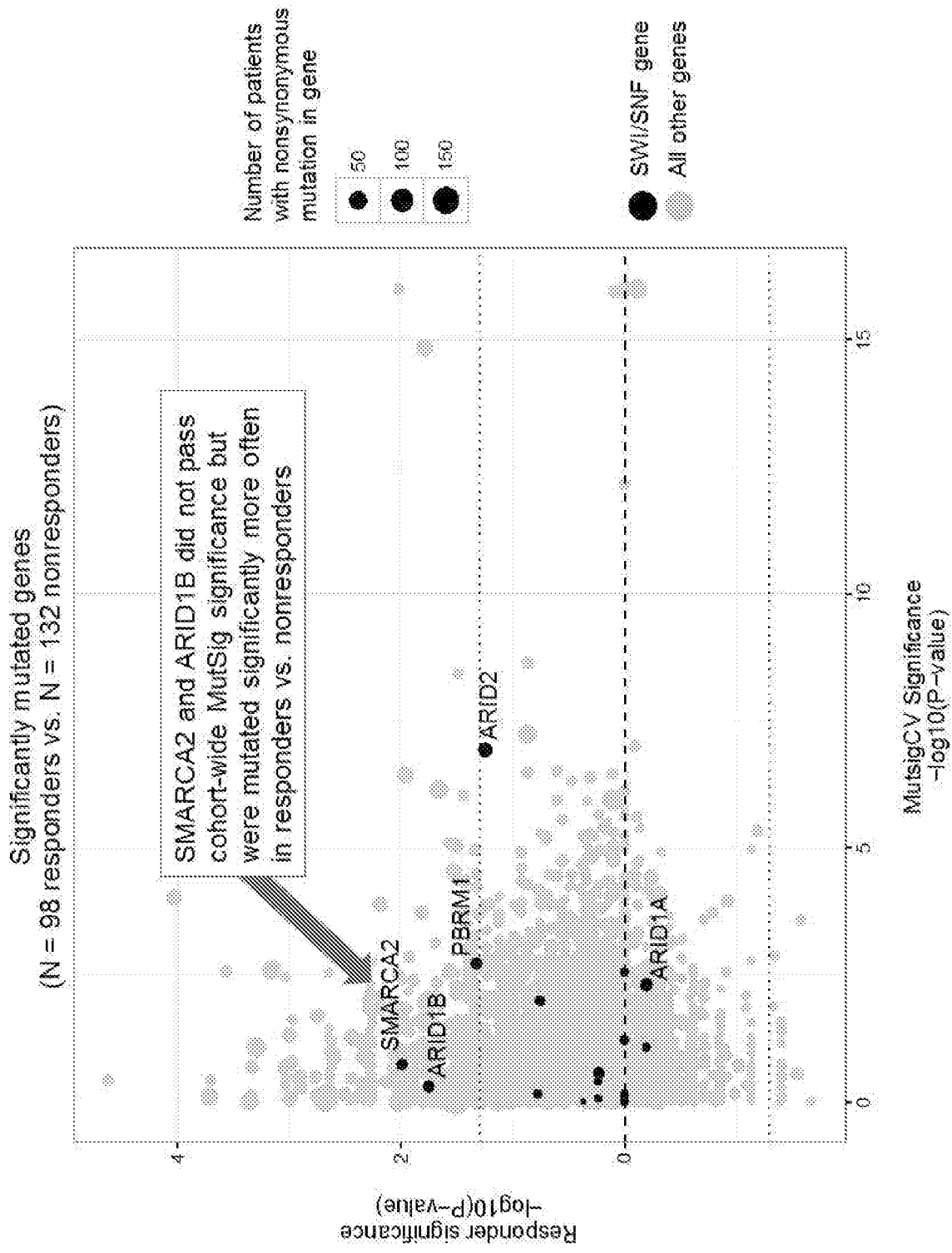
FIG. 10 shows SWI/SNF-relevant genes significantly mutated in responders vs. non-responders.

For responses, "+" represents having clinical benefit; "±" represents having intermediate benefit; and "−" represents having no clinical benefit.

significance, but were mutated significantly more often in responders vs. non-responders (FIG. 10).

Alterations in PBRM1 are a common driver in clear-cell renal cell carcinoma (up to 40%), where it has a tumor suppressor function, but are rarer in other cancer types. This cohort contained 14 patients (8.3%) with nonsynonymous mutations in PBRM1 and 4 patients (1.5%, 2 with melanoma and 2 with non-small-cell lung cancer) with truncating alterations.

Figure 11:
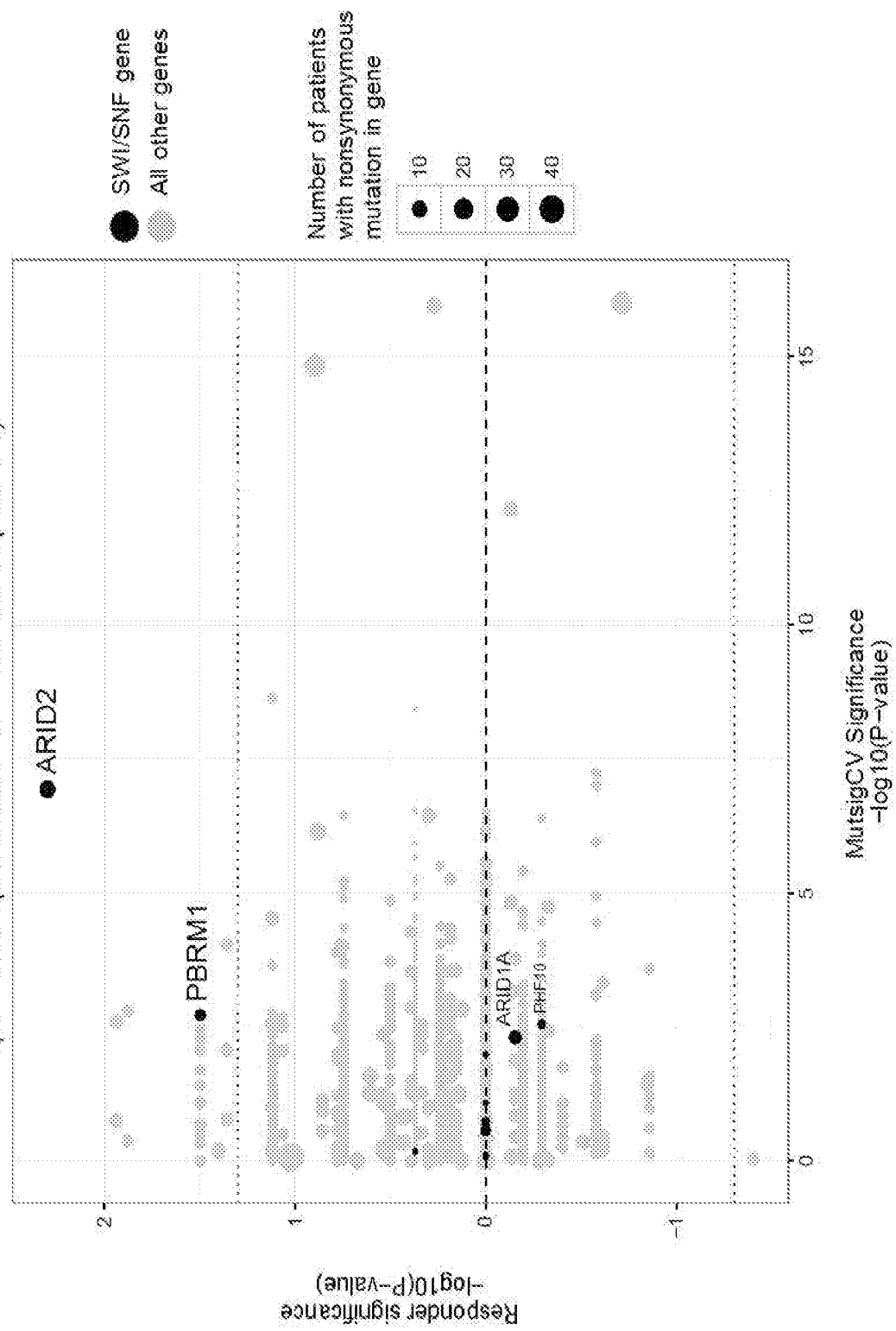
FIG. 11 shows SWI/SNF-relevant genes significantly mutated (such as those having truncating muations) in responders vs. non-responders.

Similarly, ARID2 is a common driver mutation in hepatocellular carcinoma and melanoma. This cohort contained 26 patients (15.4%) with nonsynonymous mutations in ARID2 and 12 (7.1%, 10 with melanoma, 1 with head and neck squamous cell carcinoma, and 1 with non-small-cell lung cancer) with truncating alterations. Truncating (but not nonsynonymous) mutations in ARID2 were significantly associated with clinical benefit vs. no clinical benefit after controlling for nonsynonymous mutational load (p=0.0051; logistic regression) (FIG. 11). Nonsynonymous alterations

TABLE 5

| Hugo_Symbol | n_cb_truncating | n_ncb_truncating | n_truncating | n_cb_nonsyn | n_ncb_nonsyn | n_nonsyn |
|---|---|---|---|---|---|---|
| ARID1A | 3 | 6 | 11 | 9 | 14 | 27 |
| SMARCE1 | 0 | 0 | 0 | 2 | 0 | 2 |
| ARID1B | 0 | 0 | 0 | 11 | 3 | 17 |
| SMARCA4 | 2 | 2 | 4 | 7 | 7 | 16 |
| PBRM1 | 4 | 0 | 4 | 11 | 4 | 15 |
| SMARCA2 | 1 | 1 | 2 | 9 | 2 | 12 |
| ARID2 | 12 | 2 | 14 | 18 | 14 | 32 |
| SMARCD3 | 0 | 0 | 0 | 0 | 1 | 1 |
| ACTL6B | 0 | 1 | 2 | 6 | 3 | 10 |
| SMARCC2 | 0 | 0 | 0 | 4 | 4 | 8 |
| DPF3 | 0 | 0 | 0 | 4 | 1 | 5 |
| BRD7 | 0 | 1 | 1 | 1 | 3 | 4 |
| SMARCB1 | 0 | 0 | 0 | 1 | 0 | 1 |
| DPF2 | 0 | 0 | 0 | 1 | 1 | 2 |
| SMARCD2 | 0 | 1 | 1 | 2 | 1 | 3 |
| SMARCC1 | 0 | 0 | 0 | 2 | 3 | 5 |
| DPF1 | 0 | 1 | 1 | 2 | 2 | 4 |
| PHF10 | 0 | 2 | 2 | 2 | 3 | 6 |
| ACTL6A | 0 | 0 | 0 | 2 | 1 | 3 |
| SMARCD1 | 1 | 0 | 1 | 1 | 1 | 2 |

All samples in Table 5 were taken from 98 patients with clinical benefit and 132 patients with no clinical beefit from immune checkpoint therapy "n_cb_truncating" refers to the total number of patients with truncating mutation in a given gene with clinical benefit from immune checkpoint therapy; "n_ncb_truncating" referes to the total number of patients with truncating mutation in a given gene with no clinical benefit from immune checkpoint therapy; "n_truncating" referes to the total number of truncating mutations in a given gene in the cohort (includes patients with intermediate clinical benefit); "n_cb_nonsyn" refers to the total number of patients with nonsynonymous mutation in a given gene with clinical benefit from immune checkpoint therapy; "n_ncb_nonsyn" referes to the total number of patients with nonsynonymous mutation in a given gene with no clinical benefit from immune checkpoint therapy; and "n_nonsyn" refers to the total number of nonsynonymous mutations in a given gene in the cohort (includes patients with intermediate clinical benefit).

A summary of SWI/SNF complex is illustrated in FIG. 9. ARID2 and PBRM1 are two representive genes in the SWI/SNF complex, which were found in this study as relevant to sensitivity to immunotherapies such as those antagonizing immune checkpoints. SMARCA2 (also known as BRM) and ARID1B did not pass cohort-wide MutSig in PBRM1 were marginally associated with clinical benefit (p=0.058) after controlling for mutational burden, while truncating mutations were not (p=0.98), perhaps due to the relative rarity of these events.

Figure 12:
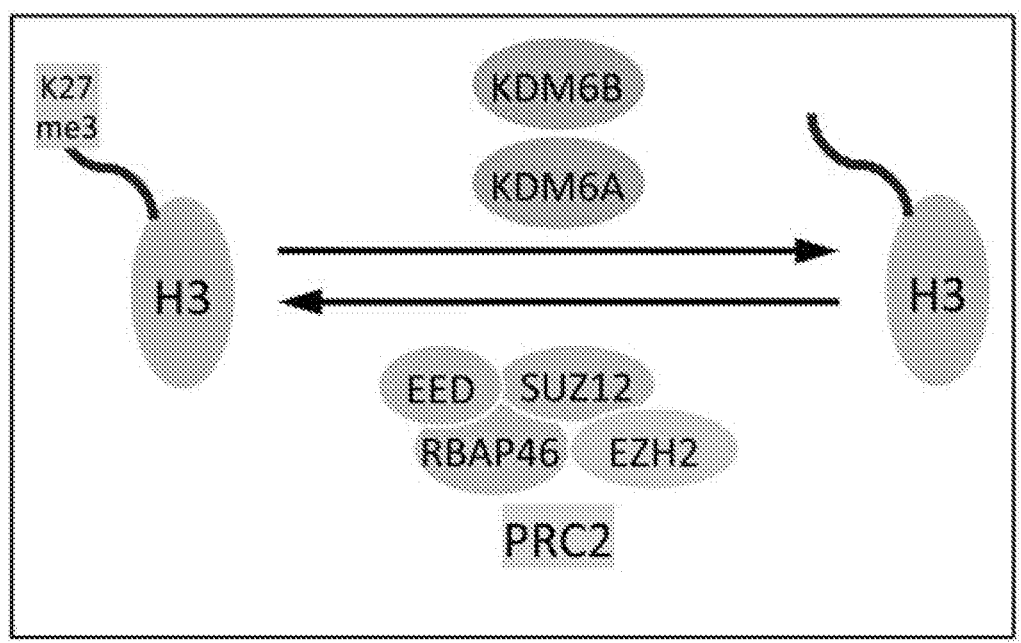
FIG. 12 depicts an enzymatic function scheme of KDM6A.

KDM6A encodes an enzyme called lysine-specific demethylase 6A that functions as a histone demethylase (FIG. 12). Truncating alterations in KDM6A were seen in 8 patients (4.8%, 5 with bladder cancer and 3 with melanoma) in this cohort. Truncating (but not nonsynonymous) alterations in KDM6A were marginally associated with clinical benefit (p=0.089; logistic regression) after controlling for mutational burden.

Immune checkpoint therapies can yield durable responses and long-lasting survival benefit across many cancer types, and checkpoint therapies have been approved for use in metastatic melanoma, non-small cell lung cancer, bladder cancer, and renal cell carcinoma, including as a first-line therapy for lung cancer. While past studies have highlighted mutational load, neoantigen presentation, transcriptomic signatures, microbiome features, and immune cell infiltration as correlated with response to immune checkpoint therapies in melanoma, non-small-cell lung cancer, and bladder cancer, the results described herein indicate that nonsynonymous alterations in the SWI/SNF chromatin remodeling complex has predictive value for patient response to immune checkpoint therapies. Moreover, other biomarkers described herein, such as additional chromatin modifying genes like KDM6A and EGFR (resistance) biomarkers, were identified. In particular, EGFR showed a strong trend with intrinsic resistance to immune checkpoint therapy in lung cancer (FIG. 6). In addition, as described further in Example 4 below, cancers with hotspot muations in EGFR are significantly less likely to respond to immune checkpoint therapies.

Thus, these results are believed to have wide-ranging implications for patient stratification for immune checkpoint therapies and those treated with other therapies, such as EGFR signaling inhibitors. Additionally, this finding drew from the largest set of clinically annotated cancer types yet collected (>200 pre-treatment patient tumors) across both well-studied and more poorly understood cancer types, lending great statistical power to detect associations. Finally, these results provide biomarkers, drug design, and combination treatment strategies across cancer types.

Example 3: Meta-Analysis of Genomic Predictors of Response to Immune Checkpoint Therapy in Metastatic Melanoma Since immune checkpoint therapies only benefit a subset of patients with metastatic melanoma and the ability to predict clinical outcomes is limited, a meta-analysis of genomic predictors of outcomes to anti-PD1 blockade and anti-CTLA4 blockade in melanoma combining 220 sequenced tumors from 3 published cohorts was conducted in order to validate existing hypotheses regarding response to immune checkpoint therapies and discover new relationships with greater power.

Nonsynonymous mutational burden was significantly higher in clinical benefit (CB) vs. no clinical benefit (NCB) using all 3 response metrics, though the significance was less pronounced when using PFS alone ($p<0.01$ vs. $p<0.0001$; Wilcoxon rank sum), partially due to 3 patients with high mutational burden who experienced PR lasting <6 months, potentially representing early acquired rather than intrinsic resistance. In order to assess the impact of mutational processes contributing to overall mutational burden, a non-negative matrix factorization framework was used to infer mutational activity in tumors from 6 signatures previously seen in melanoma: aging (S1), T>C substitutions (S5), UV (S7), mismatch repair (S6), alkylating agents (S11), and T>G substitutions (S17). Across all samples, the proportion of mutations in S7 or S11 was positively correlated with mutational burden (Spearman's rho=0.66), while S5 and 51 were anti-correlated (rho=−0.62). Additionally, in a multivariate logistic model, S7 and S11 activity were independent predictors of clinical benefit adjusting for mutational load ($p<0.05$), with the sum of S7 and S11 activity being a strong predictor ($p<0.001$). Of the patients with low mutational burden (<median) with CB, 79% had >1/2 of mutations in S7 or S11, compared to only 51% of NCB ($p<0.01$; Pearson's chi-squared). Neoantigen burden was strongly correlated with mutational burden, and did not improve ability to predict CB. In examining mutations in specific genes, >500 genes were mutated significantly more frequently in CB or NCB ($p<0.05$, Fisher's exact). Restricting analysis to recurrently mutated genes in cancer and correcting for patient mutational burden by permutation, nonsynonymous mutations in ACSL3 and MET and truncating alterations in ARID2 were significantly enriched in CB.

In this meta-analysis of 220 patients, harmonized clinical and whole exome analysis confirmed that mutational burden correlates with CB from anti-PD1 and anti-CTLA4 therapy, with mutational signatures and alterations in specific genes potentially providing additional predictive power.

Example 4: SU2C Cohort Study for Lung Cancer Immunotherapy

Analyse were also performed for a cohort of patients receiving lung cancer immunotherapy. For these patients with metastatic lung cancer treated with anti-PD1/PD-L1 therapies at the Dana-Farber Cancer Institute, whole exome sequencing was performed from the clinically annotated pre-treatment biopsies, including: 36 "pairs" of samples (pre-treatment tumor+matched germline normal tissue) and 3 "trios" of samples (LUAD-1020: 4 pre-treatment tumors (1 primary+3 metastases); LUAD-1007: 2 pre-treatment tumors; and LUAD-1011: 2 pre-treatment tumors). The baseline clinical characteristics and prior therapies is summarized in Table 6 below.

TABLE 6

| Characteristic | Patients (N = 39) |
| --- | --- |
| Age (years) - Median (range) | 60 (32-83) |
| Age > 75 - No. | 3 (7.7) |
| Male sex - No. (%) | 15 (38.5) |
| Smoking status - No. (%) | |
| Current | 11 (28.2) |
| Former | 17 (43.6) |
| Never | 11 (28.2) |
| No. of prior systemic regimens - No. (%) | |
| 0 | 3 (7.7) |
| 1-2 | 19 (48.7) |
| 3-4 | 16 (41.0) |
| 5-6 | 1 (2.6) |

Figure 15:
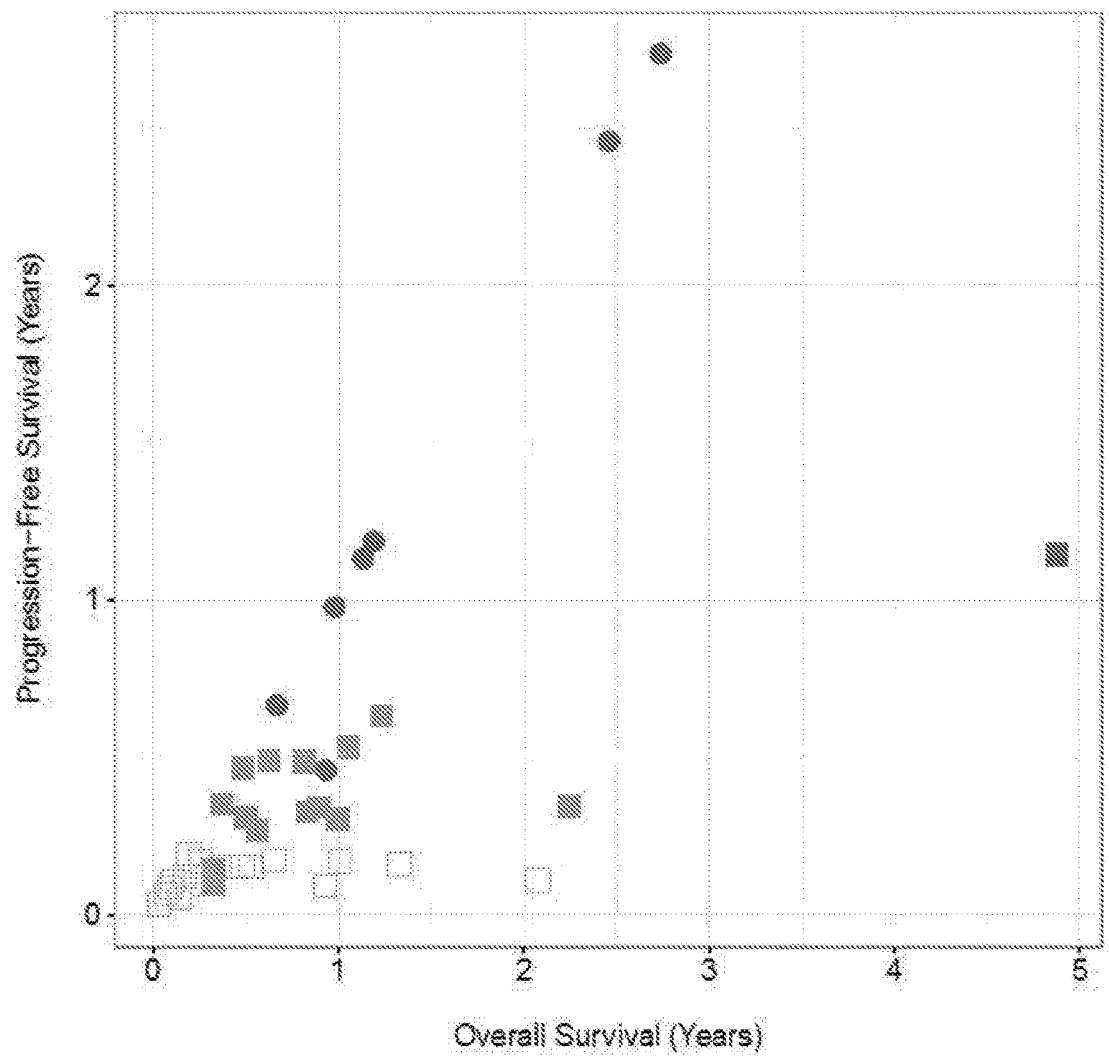
FIG. 15 depicts the different responses of 39 SU2C lung cancer patients to anti-PD-1/PD-L1 therapy.
Figure 16:
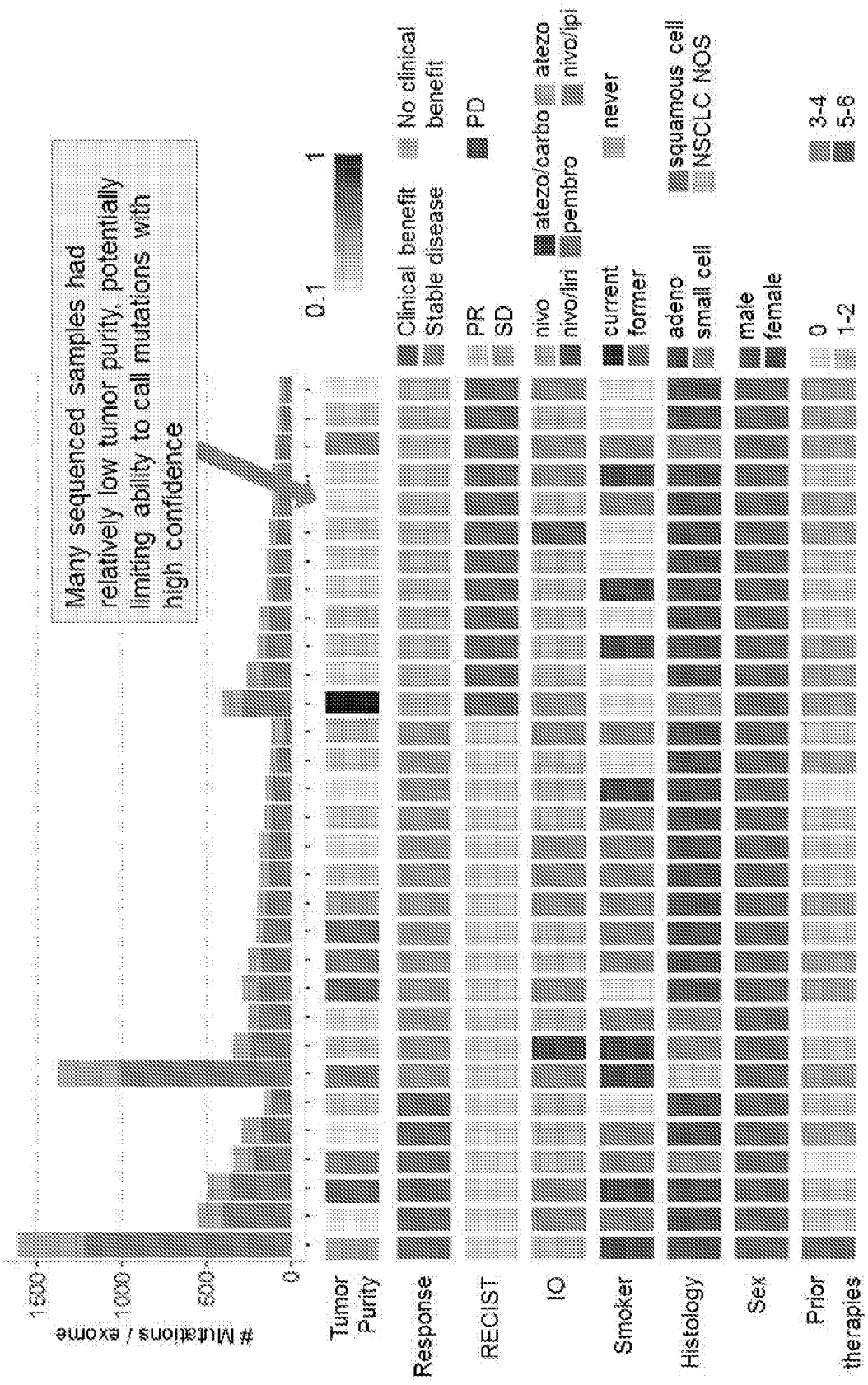
FIG. 16 shows the mutational burden and response to immune checkpoint therapies of each patient (N=31).
Figure 17:
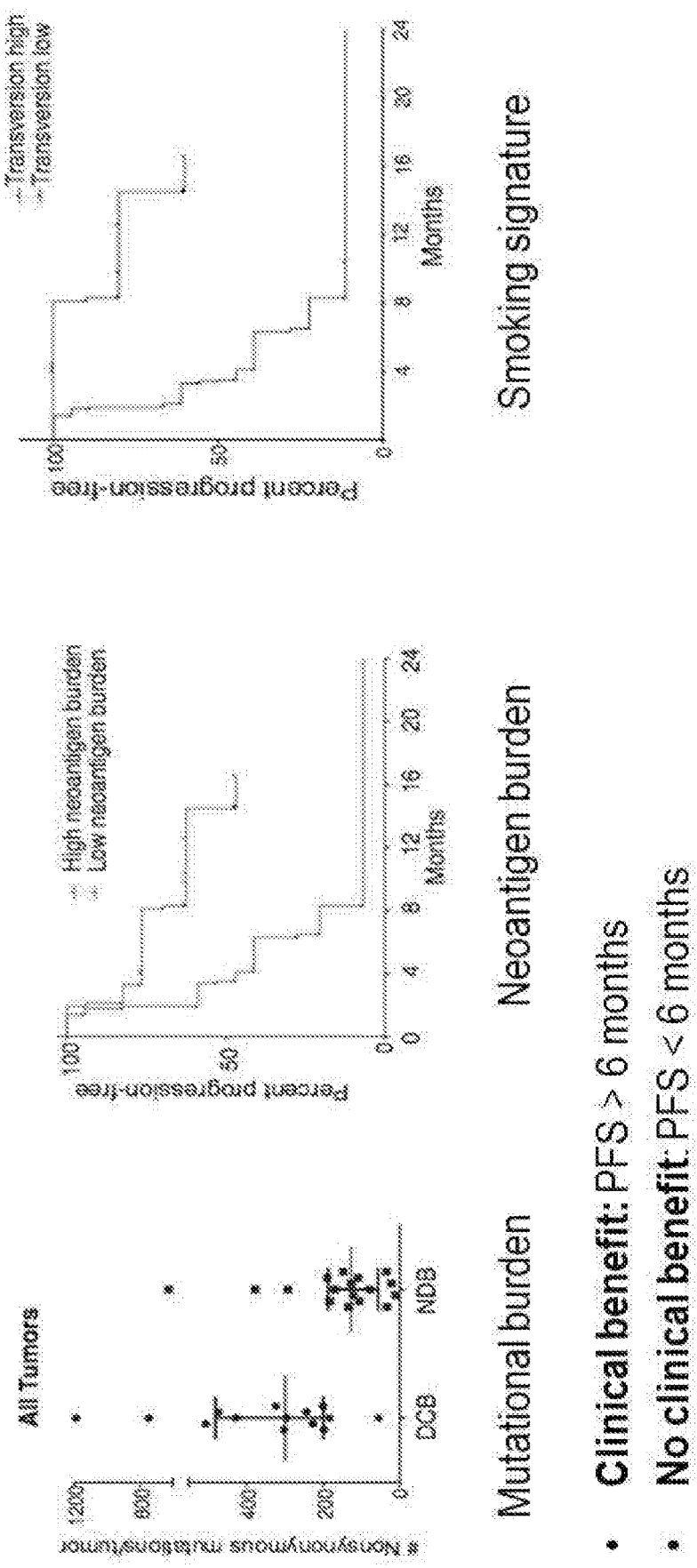
FIG. 17 shows the relationship between clinical burden and clinical benefit in a cohort in Rizvi et al. (2015) *Science* 348:124-128. RECIST was not taken into account (such that 2 patients with PR and PFS of ~4 months were considered nonresponders).
Figure 18:
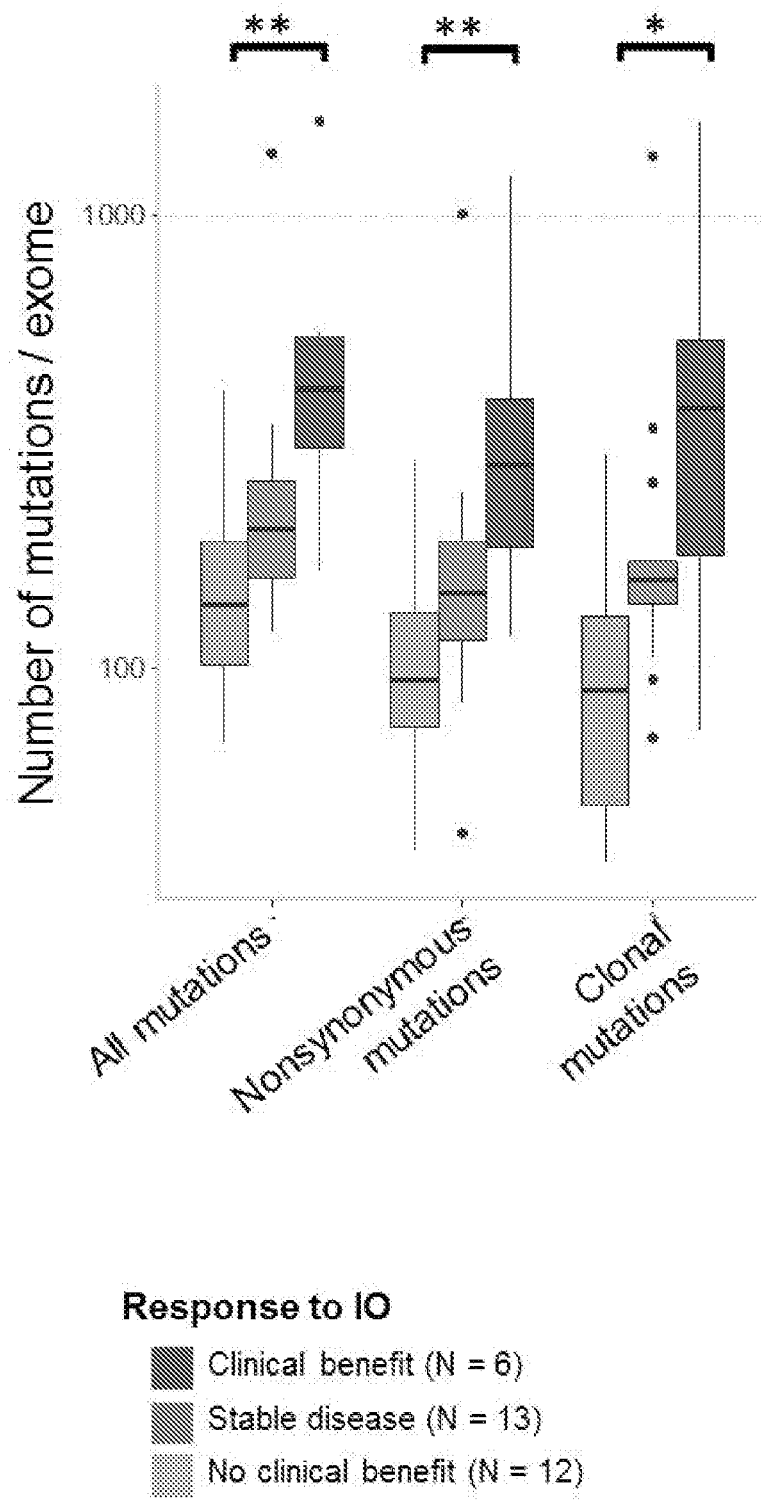
FIG. 18 shows that pre-treatment tumor mutational load was a strong predictor of response to immune checkpoint therapy in anti-PD1/PD-L1-treated lung cancer. All mutations: CB vs. NCB; p=0.003. All mutations: CB or SD vs. NCB; p=0.004. Nonsyns: CB vs. NCB; p=0.0047. Nonsyns: CB or SD vs. NCB; p=0.0064. Clonal: CB vs. NCB; p=0.024. Clonal: CB or SD vs. NCB; p=0.007. If dropping two large outliers (highest mutational load CB and SD), p-values for all mutations go to 0.009 and 0.011.
Figure 19:
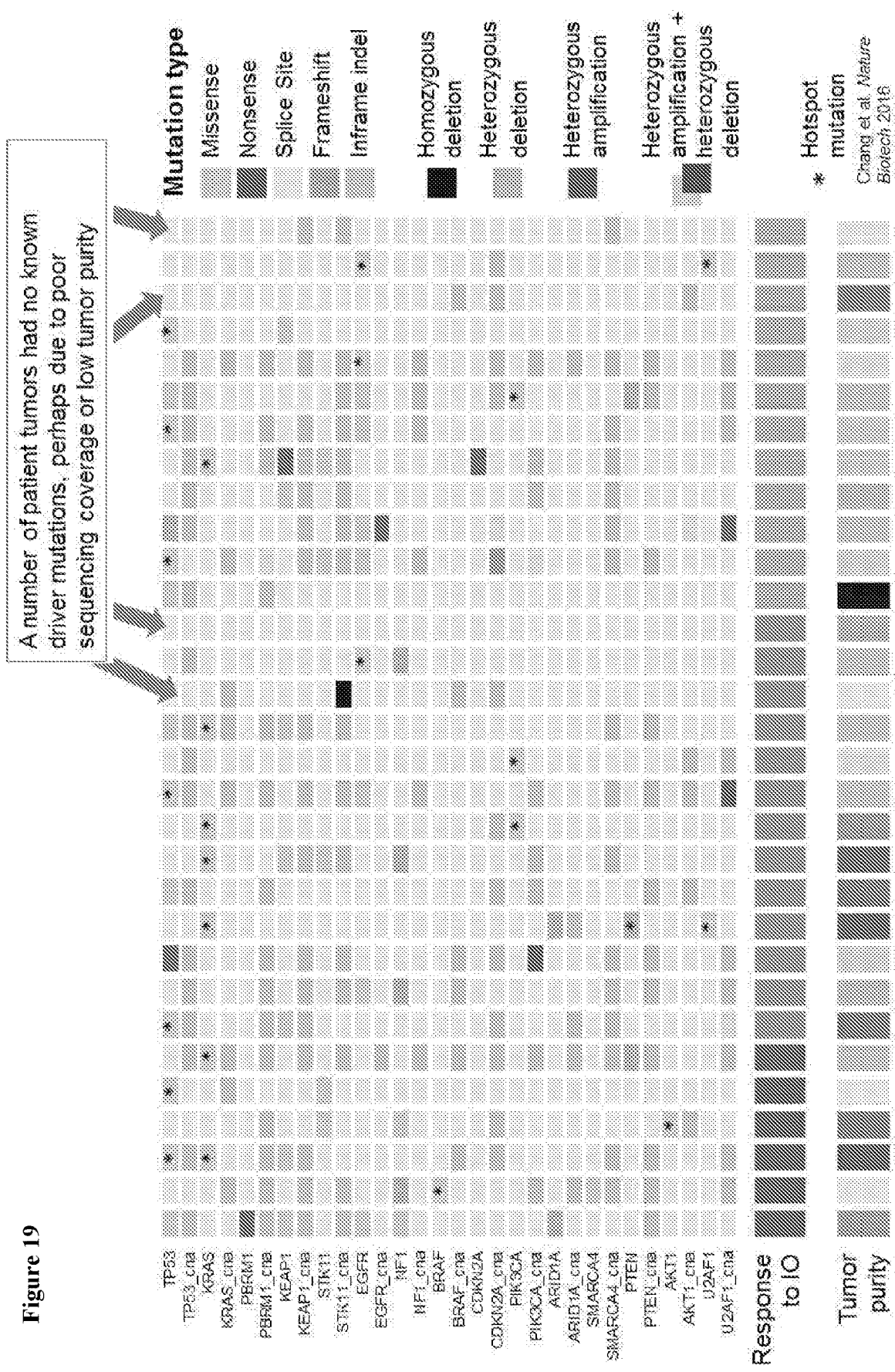
FIG. 19 shows commoly mutated genes in lung cancer. NF1 alterations were more frequent in responders (3/6 clinical benefit, 3/13 stable disease, 0/12 NCB). EGFR hotspot alterations were seen more frequently in nonresponders. KRAS hotspot alterations seen more frequently in responders (1/6 clinical benefit, 4/13 SD, 1/12 NCB). SU2C-1006: splice site mutation in MET; missense mutation in LTBP1. SU2C-1066: 3 missense mutations in LEPR. SU2C-1068: 2 missense mutations in LEPR. SU2C-1067: Missense mutations in STAG2 and SRCAP. EGFR hotspot is L858. SU2C-1066 may be excluded, since its Purity=0.36.
Figure 20:
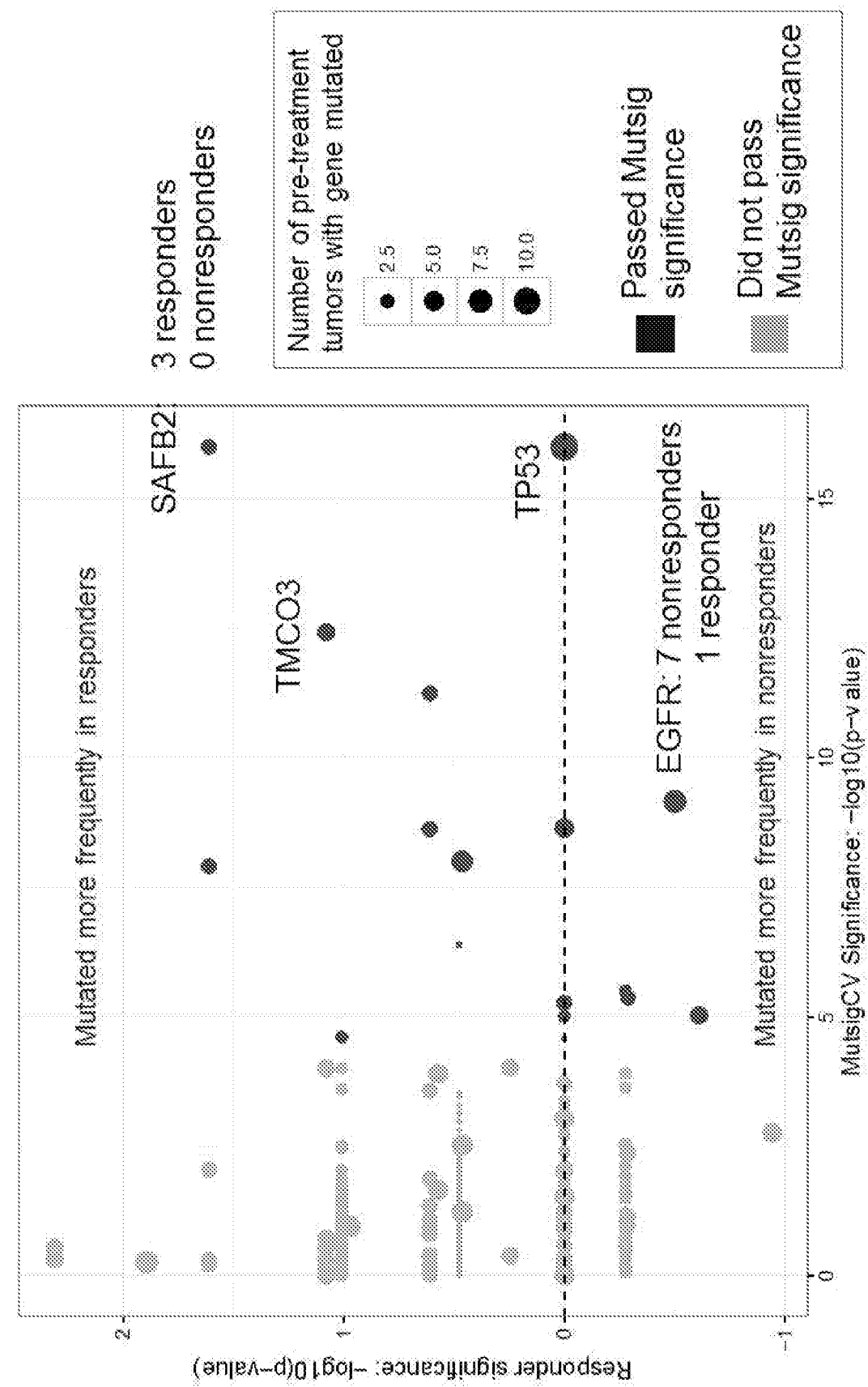
FIG. 20 shows significantly mutated genes (N=6 clinical benefit vs. 12 no clinical benefit).
Figure 21:
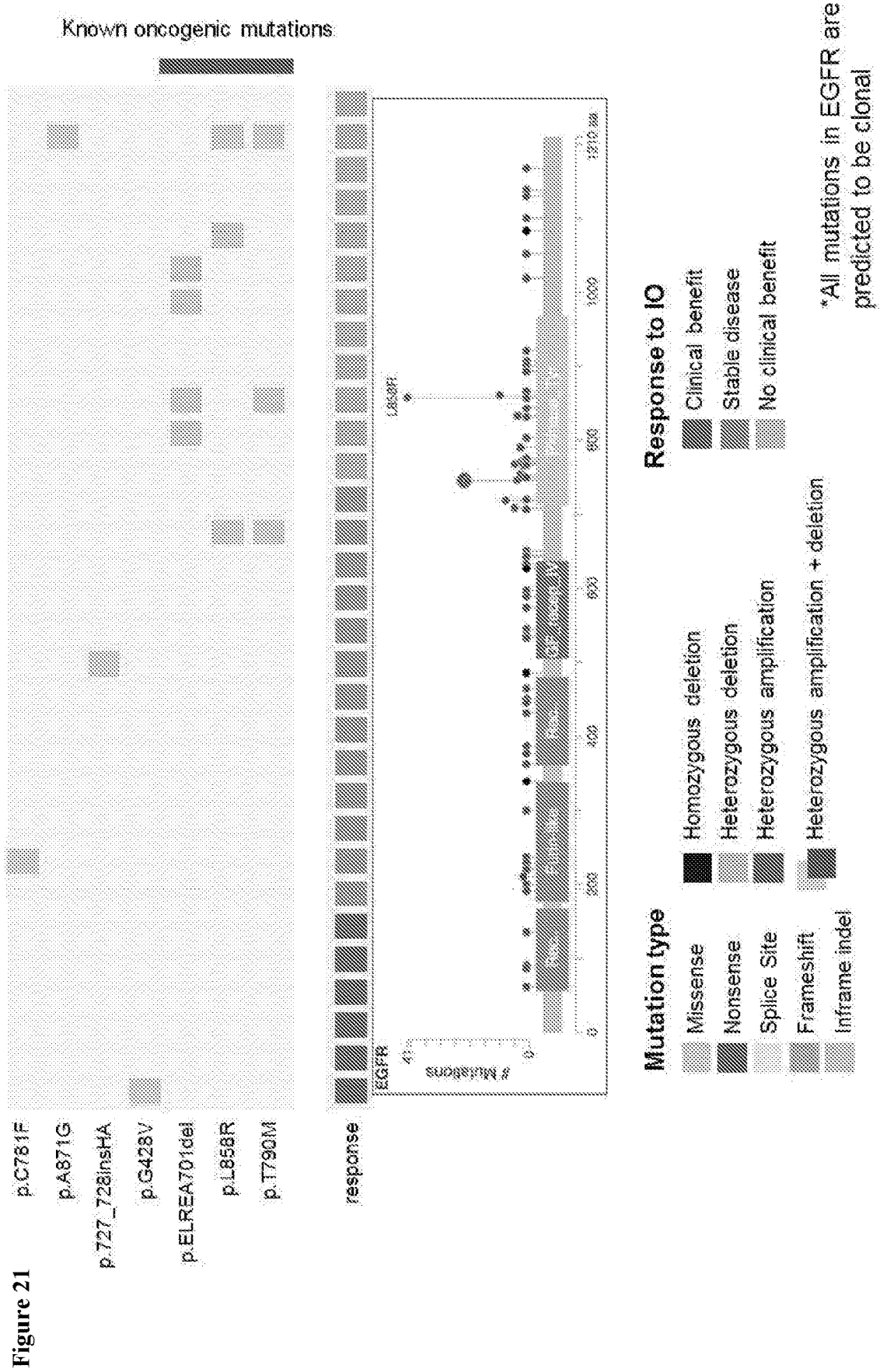
FIG. 21 shows that patients with hotspot mutations in EGFR uniformly did not respond to immune checkpoint therapy.
Figure 22:
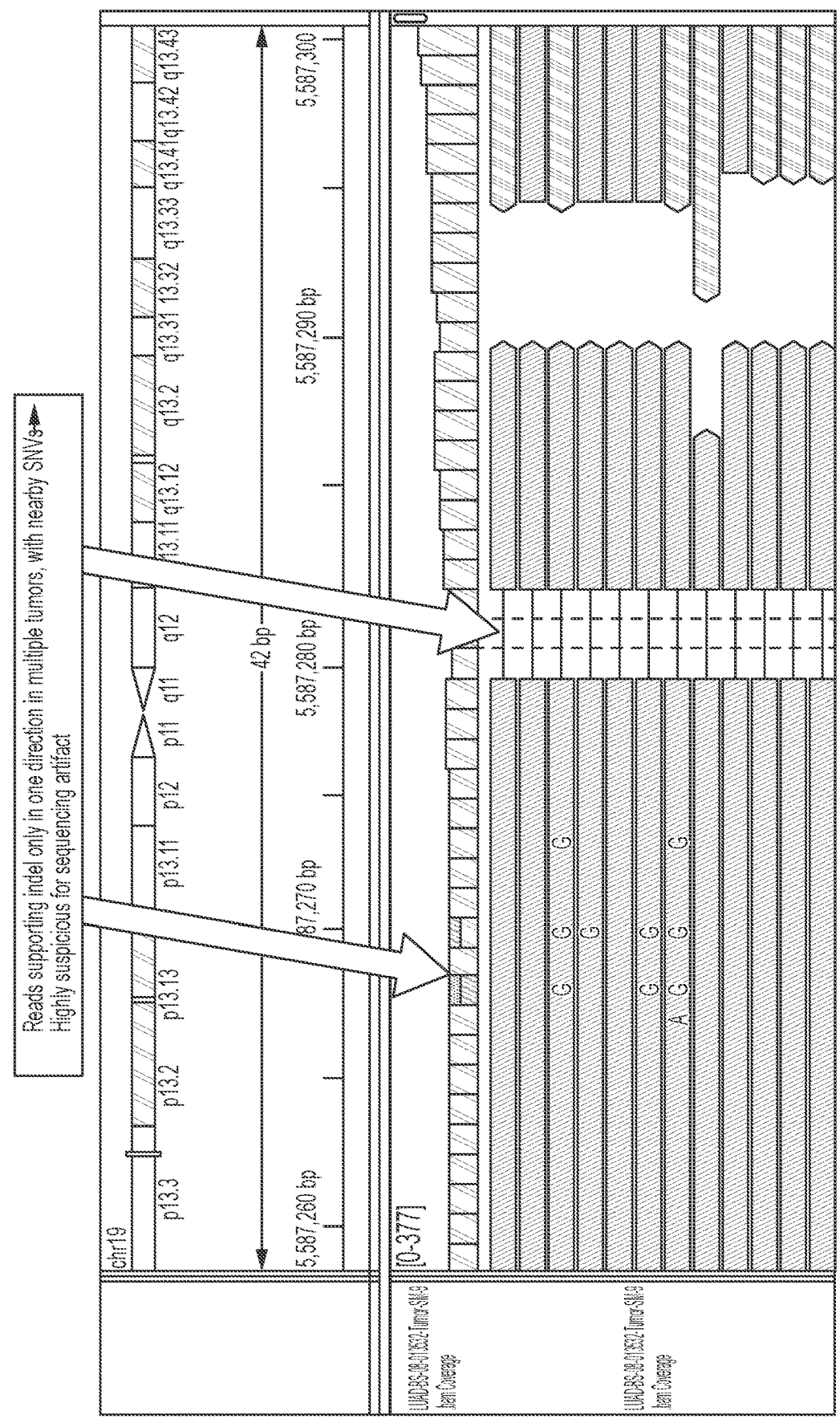
FIG. 22 shows that SAFB2 indels were likely caused by sequencing artifact.
Figure 22:
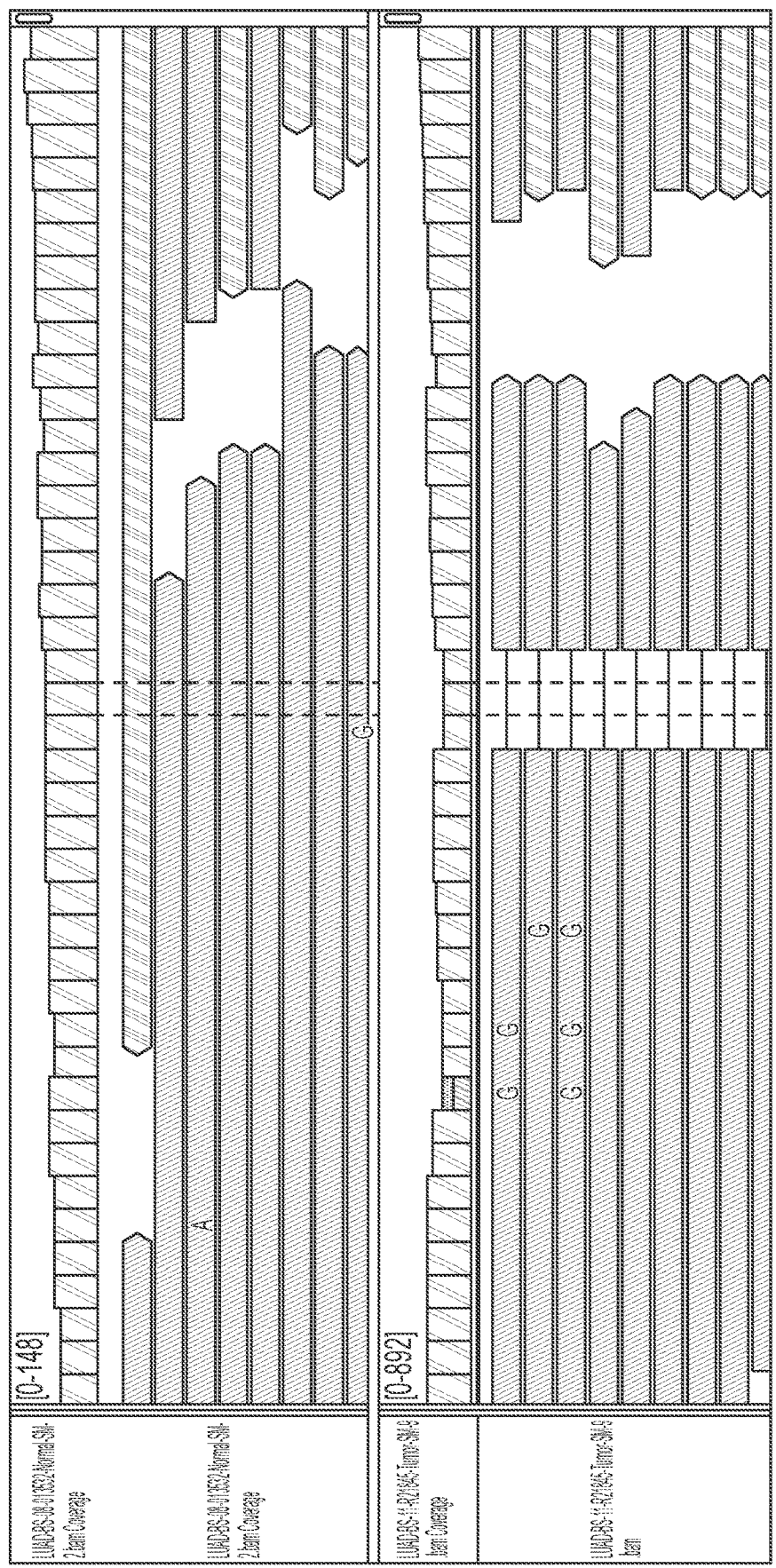

The resulting Kaplan-Meier analysis is compared for baseline clinical variables as predictors of PFS for SU2C cohort (N=39) (FIG. 13A-13D). The corresponding quality control processes are summarized in FIG. 14. As for clinical stratification, patients were divided into three groups according to their response to immunotherapy. The definition of "clinical benefit," as for the first group of patients, includes CR or PR by RECIST or SD with PFS >12 months. The definition of "no clinical benefit" includes PD by RECIST with PFS <3 months. The definition of "stable disease" (intermediate clinical benefit) includes SD with PFS <12 months or PD with PFS >3 months. A summary of different Reponses of 39 SU2C lung cancer patients to immunotherapy is shown in FIG. 15. Their mutational burden and response to immune checkpoint therapies is also compared (FIG. 16, N=31). Another cohort previously reported by Rizvi et al. (2015), supra was similarly analyzed (FIG. 17 and FIG. 18), showing that pre-treatment tumor mutational load was a strong predictor of response to immune checkpoint therapy in anti-PD1/PD-L1-treated lung cancer (FIG. 18). The current cohort of lung cancer patients were tested for any mutations to genes commonly mutated in lung cancers. As shown in FIG. 19, NF1 alterations were more frequent in responders (3/6 clinical benefit, 3/13 stable disease, 0/12 NCB). EGFR hotspot alterations were seen more frequently in nonresponders. KRAS hotspot alterations were observed more frequently in responders (1/6 clinical benefit, 4/13 SD, 1/12 NCB). The following provides additional genetic observations: SU2C-1006: splice site mutation in MET; missense mutation in LTBP1; SU2C-1066: 3 missense mutations in LEPR; SU2C-1068: 2 missense mutations in LEPR; SU2C-1067: missense mutations in STAG2 and SRCAP and an observed EGFR hotspot was L85. Sample SU2C-1066 may be excluded since its purity=0.36. A summary of significantly mutated genes in these patients is shown in FIG. 20. Patients with hotspot mutations in EGFR uniformly did not respond to immune checkpoint therapy (FIG. 21). SAFB2 indels were likely caused by sequencing artifacts (FIG. 22).

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the world wide web and/or the National Center for Biotechnology Information (NCBI) on the world wide web.

EQUIVALENTS

Those skilled in the art will recognize, or be able to ascertain using no more than routine experimentation, many equivalents to the specific embodiments of the present invention described herein. Such equivalents are intended to be encompassed by the following claims.

SEQUENCE LISTING (112 sequences)

SEQ ID NO: 1 - DNA, 7592 bp, Homo sapiens
gcggccgcggccggaggagcaatagcagcagccgtggcggccacggggcggggcgcggcggtcggtgaccgcggccggggctgcaggcggcggagcggctggaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccaggaaaaaaaaaaaaaaaaaa

SEQ ID NO: 2 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSESTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 3 - DNA, 7609 bp, Homo sapiens
gcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaat

SEQ ID NO: 4 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 5 - DNA, 8117 bp, Mus musculus
ggatttacggcagcactgggaggggtgagggcggtgagggcggcgggtgccggagagacggccgcggccagaggagcgctagcagccgtggcggccacggggcggggctcggcggtcggggaccgcagccggggctgcaggcggcggagcggcgggcttgccaacacttggtgtcacatgtgagcctcccacatgtgtgcactctccattccagctctgtgattgaactctgctcttattgactagggggcacttgggcaggcatgcttcattcctggagttgacagtcatttcataagaagttggattccatgggttccaagagaagaagagccacctctccttccagcagtgtcagtggagactttgatgacgggcaccattctgtgcctacaccaggcccaagcaggaaaaggagaagactgtccaatcttccaactgtagatcctattgctgtgtgccatgaactctataacaccatccgagactataaggatgaacagggcagactcctctgtgagctgttcattagggctccaaagcggagaaatcaaccagactattatgaagtggtttctcagcccattgacttgatgaaaatccaacagaaacttaaaatggaagagtatgatgatgttaatctactgactgctgacttccagctgctttttaacaatgcaaaggcctactataagccagattcccctgagtataaagctgcttgtaaactctgggatttgtaccttcgaacaagaaatgagtttgttcagaaaggagaagcagacgatgaagatgatgacgaagatgggcaagacaatcaaggcacactggctgacggctcttctccaggttatctgaaggagatcctggagcagcttcttgaagccatagttgtagccacaaatccatcaggacggctcatcagtgaactttttcagaaactgccttccaaagtgcaatatccagactattatgcaataattaaggaacctatagatctcaagaccattgctcagaggatacagaatggaagctacaaaagtatacacgcaatggccaaagatatagatcttctagcaaaaaatgccaaaacatacaatgagcctgggtctcaagtattcaaggatgccaattcgattaaaaaaatattttatatgaaaaaggcagaaattgaacatcatgaaatgactaaatcaagtcttcgaataaggactgcatcaaatttggctgcagccaggctgacaggtccttcgcacaataaaagcagccttggtgaagaaagaaaccccactagcaagtattaccgtaataaaagagcagtccaagggggtcgcttgtcagcaattaccatggcacttcagtatggatcagagagtgaagaggacgctgctttagctgctgcacgctatgaagaaggggaatctgaagcagagagcatcacttccttcatggacgtttccaacccctttcatcagctttacgacacagttaggagctgtaggaatcaccaagggcagctcatagctgaacctttcttccatttgccttcaaagaaaaaatacccagattattatcagcaaattaaaatgcccatatcacttcaacagatcagaacaaagctaaagaaccaagaatatgaaactttagatcatttggagtgtgatctgaatttaatgtttgaaaatgccaaacgttataacgttcccaattcagccatctataagcgagttctaaaactgcagcaagtcatgcaggcaaagaagaaggagcttgcgaggagagatgacattgaggacggagacagcatgatctcctcagccacttctgacactggtagtgccaaaaggaaaaggaatactcatgacagtgagatgttgggtctcaggaggctatccagtaaaaagaacataagaaaacagcgaatgaaaattttattcaatgttgttcttgaagctcgagagccaggttcaggcagaagactttgcgatctatttatggttaagccatccaagaaggactatcctgattattataaaatcatcttagagccaatggacctgaaaataattgagcataacatccgaaatgacaaatatgcaggtgaagaaggaatgatggaagacatgaaactcatgttccgcaatgccaggcactacaatgaggagggctcccaggtatacaatgatgcccatatcctggagaagttactcaaagataaaaggaaagagctgggccctctgcctgatgatgatgacatggcttctcccaaacttaaattgagtaggaagagtggtgtttctcctaagaaatcaaagtacatgactccaatgcagcagaaactgaatgaagtgtatgaagctgtaaagaactatactgataagaggggtcgccgccttagtgctatatttctaagactcccctctagatcagagctgcctgactactacctgaccattaaaaagcccatggacatggaaaaaattcgaagtcacatgatggcaaacaagtaccaagacatagattctatggtagaggactttgtcatgatgtttaataatgcctgtacctacaatgaaccagagtctttgatctacaaagatgcccttgtactgcataaagtcctccttgagactcggagagacctggagggagatgaggattctcatgtccctaatgtgacgttgctgattcaagagctcatccataacctttttgtgtcagtcatgagtcatcaggatgacgaagggaggtgttacagcgactccttagcagaaattcctgctgtggatcccaactctcccaataaacctccccttacatttgacattatcaggaaaaatgttgaaagtaatcggtatcggcgacttgatttatttcaggagcatatgtttgaagtattggaacgggcaagaaggatgaaccggacagattccgaaatatatgaggatgctgtagaacttcagcagttttttattagaattcgtgatgaactctgcaaaaatggagagatccttctttctccagcactcagctataccacaaaacacttgcataacgatgtggaaaaagaaaaaaaggaaaaattgcctaaagaaatagaggaagataaactaaaacgcgaagaagaaaaaagagaagctgaaaaaagtgaagattcctcaggtactacaggcctctcaggcttacatcgtacatacagccaggactgcagctttaagaacagcatgtatcatgtcggagattatgtctatgttgaacctgcggaggccaatctacaaccacatatagtgtgtattgagagactgtgggaggattcagctggtgaaaaatggttgtacggctgttggttttatcggccaaatgaaacattccatttggctacacgaaaatttctagaaaaagaagtttttaagagtgactactacaataaagtacctgttagtaaaattctaggcaaatgtgtagtcatgtttgtcaaggaatactttaaattatgtccagaaaactttcgcgatgaggatgtttttgtctgtgaatcgaggtattctgccaaaaccaaatcttttaagaaaattaaactgtggaccatgcccatcagttcagttagatttgtccctcgggatgtgcctttgcctgtggtccgagtggcctctgtgtttgcaaatgcagataaaggggatgatgagaagaatacagacaactcagatgacaatagagctgaagacaattttaacttggaaaaggaaaaagaagatgttcctgtggagatgtccaatggtgagccaggttgccactactttgagcagcttcggtacaatgacatgtggctgaaggttggtgattgtgtcttcatcaaatcccacggcttggtgcgccctcgtgtgggcagaattgagaaagtatgggtccgagatggagctgcatatttttatggccctatcttcattcatccagaagaaacagaacatgagcccacaaaaatgttctacaaaaaagaagtgtttctgagtaatctggaagagacctgccctatgagttgtattctggggaaatgtgcagtgctgtcattcaaggacttcctctcctgcaggccaactgaaataccagaaaatgacattctgctttgtgagagccgctataatgagagtgacaagcagatgaagaagttcaagggtttgaagaggttttcactctctgctaaagttgtagatgatgaaatctactacttcagaaaaccaatcattcctcagaaggaaccctcacctttgttagaaaagaagatacaattgctagaagctaaatttgcagagttagaaggaggagatgatgatattgaggagatgggagaagaggatagtgaagtcattgaagctccatctctacctcaactgcagacacccctggccaatgagttggacctcatgccctatacacccccacagtctaccccaaagtctgccaaaggcagtgcaaagaaggaaagttctaaacgaaaaatcaacatgagtggctacattttgttcagcagtgaaatgagagctgtgattaaagcccagcacccagactactcttttggggagctcagcagactggtggggacagaatggagaaaccttgaaacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggcatgatgggtggctatccgccaggccttccacctttgcagggcccagttgatggccttgttagcatgggcagcatgcagccacttcaccctggggggcctccacctcaccatcttccgccaggtgtgcctggcctcccaggcatcccaccaccgggtgtgatgaatcaaggagtagcccccatggtagggactccagcaccaggtggaagtccgtatggacaacaggtaggagttttgggacctccagggcagcaggcaccacctccatatcctggtcctcatccagctggcccccctgtcatacagcagccaacaacgcccatgtttgtggctcccccaccaaagacccaaaggcttctccactcagaggcctacctgaaatacattgaaggactcagtgctgaatccaacagcattagcaagtgggaccaaactttggcagctcgaagacgggatgtccatttgtccaaagaacaggagagccgcctaccttctcactggctcaaaagtaaaggggcacacaccaccatggcagatgccctctggcgcctacgggatttaatgcttcgagacactctcaacatccgacaggcatacaacctagaaaatgtttaatcacatcactgtttcttctgtggaagcaaagagttgtggagcggtagccattttagttactggggtgggagggaggaacaaaggatgataatttttattgcattttattgtacatcacacagccatttttatataaggacacttttaataagctatttcaaatttggttttgttacattaagttgactatcaaatacacaaaagattttttttgcatatgtttcctttgtttaaaaccagtttcataattggttatatatagtaatagttttatctttacttgttaaaggacttaaatcatcaaaggttttggcttggcttagggttttcgttttcttttttataaatatatattatatatatatacacatataaaagaaaaaatgaaaaaaaagtttacaaatttaagttgacaatgaaatgtgaagttggtcctagtttacatcttagaggaatgtatatgtatgttttacatgcctaaatatctgcaggttttcttacaggtaaagcgaagtgctttgaaaagtttagattatacatgtgtgacagatgcggcatatttgctctattaacacagaggcttactatagaaatctaaagtcaatgctgtacatccatccagttagtgtaactgaagggaaatgtaactttgtgctgagttagacatctgtattgtcagtgattcttgtagaatatgtgctcagatctgagttatatttagttttggaaggtaagttgaagagtacttttgatcagtttatgattcagtttatgattttagtttttgccttcatgttatacatttatgatttgaaactgtacatctgttaccttgaaaaacattgaagaaagtactgaagtgtgcatggaggtggtttaagcataatacttaacccaagaaagagtgtaagtggacacaagctgtgcctgcacatagctgtgcagggtagactgcctacatacacatggccgggattctttatttccttgttatcaattatagtgctttgtttgtttcagggttggaattctcaaccagaaataatactttctaaaatattttaaaattcagcttgtgctttggattatagaaggaaattatactttaagaaaatgttcacaaaaaaaaaaaaaaaaaaaggactattacagatcccaatacttggatttggtgaccttgtctttctttcttttcttgagacatggtcctactaccaaccctggctggactggagctcagtgtatagaccaggctagtctcaaactctgcctcttcctcccaagtgctgggattaagggcaggtaccatagtgctcagcaaccacaaccctgtctttccaacacggccctagcgtaagcactgaggcagtgtgcagtgctcaggcagcagcaaacatttcccgggggtggttttgaacctgcttgggtggttgtgtggtgctgacgctgccactgccctgttgttcattgagaatgattgttaaatgacactcttcctttagaatataacggatcagtactcatgtttaattgccatgcttaataaatcatgagaacaaaagagtatagaatggaaagcattccctggtagctactttaaatacaggagccctgtaacttaataccagtagtcaaccactggatctcagttttcatcaagtattttaaataaataatcttaaattttaaaatacgtactgcagagtatgccagtatcttattgttaaaactgaatcaaataaatcttcgattcctggttatttggaccattgactcatcatggactatataatgtaataagattcttttctcttaaggtatccttgaattacaccaaagaaccagaaacttaattttggttaaattatttatttatttcatgcattaattttctttttctttttaaaggtttagatgaggctccttagggagtctctaaaaccgcttcactatcagcaaccaggagtactagaagccagagcactcttcctcctggctcctccccagtgctctagtgctgtaggaaccaagagccagccccaggttccccgaggcagtaaaaatccagcacagggggctgtgtccctaaggcaagccctgattacctttaaaaaaaaccaaaaaaacaaacaaaaaaaaaaaacctaattaactaaagcatttaaggcactatttattttagaatcatgcttttgaagagcatcagtgattacttagggtgtaatatgtaaagatcagacatctccaaaaacagaaaaagtacaagtaaacaacacactttctcatgacttttaagaactgtagtaatgtggcttaggaaatataatggcctaattgttttcaaaatgtaagttcctgtgaagaattttgtttatattgggttggggacctataggtttaaaatagaatgtcagtcagctgacttaaaaaacattggttttactaagtctgccttccccttctaaggaagaactgagtgggtaagggacaggtgtgtaaaatctccaaatggatgttacagctttcagcttgaacgtttgtttccagacctgattaaaatttggtttattctaatttctgtactatatcatctgaggttttaagtggtaactggttctataccatgtatgtatcatatgtttgttcatcaaagctttttaatccaaataaaaacaacagtttgcaaagtga

SEQ ID NO: 6 - protein, 1704 aa, Mus musculus
MGSKRRRATSPSSSVSGDFDDGHHSVPTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKAYYKPDSPEYKAACKLWDLYLRTRNEFVQKGEADDEDDDEDGQDNQGTLADGSSPGYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMTKSSLRIRTASNLAAARLTGPSHNKSSLGEERNPTSKYYRNKRAVQGGRLSAITMALQYGSESEEDAALAAARYEEGESEAESITSFMDVSNPFHQLYDTVRSCRNHQGQLIAEPFFHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMMEDMKLMFRNARHYNEEGSQVYNDAHILEKLLKDKRKELGPLPDDDDMASPKLKLSRKSGVSPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNSPNKPPLTFDIIRKNVESNRYRRLDLFQEHMFEVLERARRMNRTDSEIYEDAVELQQFFIRIRDELCKNGEILLSPALSYTTKHLHNDVEKEKKEKLPKEIEEDKLKREEEKREAEKSEDSSGTTGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSDDNRAEDNFNLEKEKEDVPVEMSNGEPGCHYFEQLRYNDMWLKVGDCVFIKSHGLVRPRVGRIEKVWVRDGAAYFYGPIFIHPEETEHEPTKMFYKKEVFLSNLEETCPMSCILGKCAVLSFKDFLSCRPTEIPENDILLCESRYNESDKQMKKFKGLKRFSLSAKVVDDEIYYFRKPIIPQKEPSPLLEKKIQLLEAKFAELEGGDDDIEEMGEEDSEVIEAPSLPQLQTPLANELDLMPYTPPQSTPKSAKGSAKKESSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 7 - DNA, 8619 bp, Homo sapiens
ggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaaaaaaaaaaaaaaaaaaaaaaa

SEQ ID NO: 8 - protein, 1835 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 9 - DNA, 5703 bp, Homo sapiens
ggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaaaaaaaaaaaaaaaaa

SEQ ID NO: 10 - protein, 1788 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRR

SEQ ID NO: 11 - DNA, 9029 bp, Mus musculus
gcgccgccgccgccgccgccgccgccgccgccgccgccaccgccggcccatgactgagccccgccaccgccggccgaggaatgggctccgggcgctggtagggagcgcggggagcgggggccgcgtttgaaccgcgatctgggttttttcgggagacctcctttggcaaaataatggcaaactcgacggggaaggcgcctccggacgagcggaggaagggactggctttcctggacgagctgcggcagttccaccacagcagagggtcgccgtttaagaagatccctgcggtgggtgggaaggagctggatcttcacgggctctacaccagagtcactactttaggcggattcgcgaaggtttctgagaagaatcagtggggagaaattgttgaagagttcaactttcccagaagttgttccaacgctgcctttgctttaaaacagtattacttgcgttatctagaaaagtacgagaaagttcatcattttggggaagatgatgatgaggtaccaccaggcaatccaaagccacagcttcctattggtgcaatcccatcttcctacaattaccagcaacacagcgtgtcagattatctacgtcaaagttatgggttatctatggattttaattcgccaaatgattataataaactggtgctttcactgttatctggactcccaaatgaagtggacttcgctattaatgtgtgcactctcctatcaaatgaaagcaagcacgtcatgcagcttgagaaggatcccaaaatcatcactttactgctcgctaatgcgggggtgttcgatgacactttaggatcattctcttctgtctttggagaagagtggcgagagaagactgatagagactttgttaagttttggaaagacattgttgatgacaatgaagtgcgagatctcatttctgacagaaacaaggctcatgaagatacaccaggagaatggatttgggaatctttatttcatccacctcgaaagctgggcattaatgacatcgaaggccagcgggttctgcagatcgcagtgatcttgcggaacctctcctttgaggagagcaatgttaagctcttggcagctaatcgcacctgtctgcgtttcctgttgctctctgcacacagtcattttatttcattaaggcagctaggcctggacaccttagggaatatcgcagctgagcttttactggaccctgtggatttcagaaccactcatctgatgtttcacactgttacaaaatgcctgatgtcaagggataggtttttaaagatgaggggcatggaaattttgggaaatctctgcaaagcagaggataacggtgttttgatttgtgaatatgtggatcaagattcctatagagagataatttgtcacctcactctgcccgatgtgctgctggtgacctcaaccctggaggtgctgtacatgctcactgaaatgggggacgtggcctgcacaaagatcgcgaaagtggagaagagcatagacgtgctggtgtgtctggtctctatggacgctcagatgtttggacctgacgcacttgctgccgtgaagctcattgagcatccgagctccagtcaccaagtgttatcagagattaggccgcaagccatagagcaggtccaaacccagacccacatagcctccggtccagcttccagagcagttgtagcacagcatgctgccccccctccaggaatcgtggaaatagacagtgagaagttcgcttgtcagtggctaaatgctcattttgaagtaaatccagactgttccgtctctcgggcagaaatgtattcagagtacctctcaacttgcagtaaattagctcgcggtggcatcctcacatcaactgggttttataagtgtcttagaacagtttttccaaatcatacagtgaagagggtagaagattccactagcagtgggcaggcgcatatccatgtcataggagtgaagcggcgggctctcccgctccccatccagatgtactatcagcagcagccaatttccactcctgttgtccgtgttgatgctgttgctgatctatctccaactccttcacctgcaggaatccctcatggaccacaggctgcagggaatcattttcagaggactcctgtcaccaatcaatcttcaaatttgactgcaacacaaatgtcttttccggtacaaggcattcatactgtggcacagactgtttccagaattccaccaaatccttcagttcatacccaccagcaacaaaattctccagtaactgtcattcagaataaagctccaattccttgtgaagtcgttaaggcaacagtaatccagaactctgtgccccagacggcagttcctgtgagtatctctgttggaggagcacctgcacagaattctgtgggtcagaaccatagtgcagggccacagcctgttacagttgtaaattctcagacattacttcaccatccttctgtgatgccacagccatctccactacacacagtggtgcccggacaggtcccttcaggcactcctgtcacagtaatccagcagactgtaccgcagagtcgtatgtttggacgagtacagagcataccagcgtgtacatctaccgtctcacagggtcagcagttaatcaccacatcaccacagcctatgcacacttcatctcaacagacagcagctggtagccagccacaagacactgttatcatagcacccccacagtacgtaacaacttctgcatccaatatcgtctcagcgacttcagtacagaatttccaggtagctacaggacaggtggttaccatagctggtgtcccgagcccacagccctccagggtaggattccagaacattgcgcccaagccacttccttctcagcaagtttcaccatcagtggtccagcagcctattcaacaaccacagcagcctgctcagcagagtgtagtgattgtgagccagccagcacagcaaggccaggcgtacgcaccagccattcaccagatcgttctcgctaacccggcagctctccctgccggtcagacggttcagctaactggacaaccaaacataactccatcgtcatcaccatcacctgtcccgcctactaataaccaagtccctactgccatgtcatcttcttccacccttcagtcacagggaccccctcctactgtcagtcagatgctctctgtgaagaggcagcagcagcagcagcactcaccagcagcgccagcacagcaggtccaggtccaggttcagcagccgcagcaggtccaggtgcaagttcagccgcagcaaccgagtgctggggtcggtcagcctgctcccaacgagtctagtctcatcaagcagctgctgctgccaaagcggggcccttcaaccccagggggcaagcttatcctcccagcccctcagattcctccccctaacaatgcaagagctcctagccctcaggtggtctatcaggtggccaataaccaagcagctggttttggagtgcaggggcaaactccggctcagcagctattggttgggcagcaaaatgttcagttggtccaaagtgcaatgccacccgcagggggagtgcaaaccgtgcccatttcgaacttacaaatattgccgggtccgctgatctcaaacagcccagcaaccattttccaagggacttctggcaaccaggtaactataacagttgtgccaaataccagttttgcaactgcgactgtgagtcagggaaacgctgctcagctcattgcgccagccggtcttagcatgagcggagcgcaggcaagcgctggacttcaggtgcagacgcttccagccggacaatcagcgtgtaccactgctcccctcccgttcaaaggcgacaagatcatttgccaaaaggaggaggaggcaaaggaagcaacaggtctacatgttcatgaacggaagattgaggtcatggagaatccttcctgtcggcgaggaaccacaaacaccagcaacggggatacaagtgagagtgaactccaggtgggaagtcttttaaatgggagaaagtatagtgactcaagtctacctccttcaaactcagggaaacttcagagtgagacgagccagtgctcactaatcagcaatgggccatcgttggaactaggtgagaatggagcgcctggaaaacagaactcagaaccagtagacatgcaggatgtcaaaggtgatctgaaaaaagccctcgtcaatggaatctgtgattttgataaaggagatggttctcatttaagcaaaaacattccaaatcacaaaacttctaatcatgtaggaaatggtgagatatctccagtagaaccacaagggacttcgggtgccactcagcaagatactgccaaaggtgaccaactagaaagagtttctaatggacctgtgttaactctgggtgggtcaccgtccacaagcagtatgcaagaagccccgagtgtggcgacaccgccgttgagtggtactgacctgcctaacggacctctagcttcaagtttgaattcagatgtgcctcagcaacgcccaagtgtagttgtctcaccacattctacagcccctgtcatacaggggcatcaagtcatagcagttccccactcaggacctagagtgaccccttctgctctatcatctgatgctcggtctacaaacggcacagccgagtgcaaaactgtaaagaggccggcagaggataatgatagggacactgtcccgggaatcccaaataaagtaggggttagaattgttacaatcagcgaccccaacaatgctggctgcagtgcaaccatggttgcggtcccagctggagcggacccaagcactgtagcgaaagtagcaatagaaagtgctgctcagcaaaagcagcagcatccaccgacctacatgcagagtgtggccccacagaacactcctatgccaccttcaccagctgtacaagtgcagggccagcctagcagttctcagccttctccagtcagtgcgtccagtcagcatgcagatccagtgagaaaacctgggcagaacttcatgtgtctgtggcagtcttgtaaaaagtggtttcagactccctcacaagtgttctatcatgcagctactgaacatggaggaaaagatgtgtatccggggcagtgtctttgggaaggctgtgagcctttccaacggcagaggttctctttcattacccacttacaggataagcactgttcaaaggatgccctgcttgcaggattaaagcaagatgaaccaggacaagtggcaaatcaaaaatcttctaccaagcagcccaccgtggggggcacaggctctgcgcccagagcccagaaggccattgcaagccaccccagtgctgcactcatggctctgcggagaggctcaaggaacctcgtcttccgggacttcacagatgaaaaagagggaccaataactaaacacatccgactaacagctgccttaatattaaaaaatattggtaaatactcagagtgtgggcgcagattgttaaagagacatgaaaacaacttatcagtgctcgccattagtaacatggaagcttcctctacccttgccaaatgcctttatgaacttaattttacagttcagagtaaagaacaagaaaaagactcagaaatgctgtagtgaatcctaccccactgacacagtggggtctcaaagtcaaatacatttcacatactgttactgaagaaagcaccaagtcttaatggagcagagaccatagaatgaattattttgtgtcctccatgatgctgagaggaaacttcgtattctgatctctgaacgaatccctttcttttctgttaaaaaaaaaaaatctaaaaaggaaaaaaaaaaaaaaaaaaacaaaaactgctgtgggattgtcaaccagcttatctgcaggatgtctcggatctggccaatcctgatggaaactggtgtgatcagaattctgtaccatccacattggaatatacatggaatagtgtaaaacctacgtgagcagatgaaatagaagcattaaatatttttatctatatccaaaaaggagcacatttttatatttacagaaccatttaagctggtttgaataacgacagagtttgagcacacctatcccccagcttcagaggggccaccaatatctagctgtggattgtgtgttttgtttagaatcagtagcttggttttcttacttgagccaatatattttcacttatttattatcataaaaatttaccagtctgaatagatcttgtaaatatttgtgaatagaatgaacactgttcataccactgcagccactggagatacatcctgtggtgtcctagaagcattatcggtaggctctaaagttttctagactttgctgtcaactgtaagtaattgtgatatattctacgcagtggatggatattctttaaatctgtgtaaatacttctgcaaaggtactgatgctgtaaagtcaaacagttttgtggaactgtgattttttttttcctccttttttggtttccttggcccccacttgggtttggtggggttttgtttttgttttgttttgtattatacaccttgtagaactcattttgctggctgaaagagtatggaataatatatctcatatgtcatttttgtagaagagaaactatttggatttcctttttgttggtttggttttccctaacacgtgtccgctgtacgcattcgtcacgtgcaagctcagcttgtgcagggttttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttcccccaagcgtgaaatgtatccacttataactgcctattgcctgttctattagcatccaaaaatgtggaaggcctcccaaccaccatttctgctgtgtccttaggatgtgcagtaaaaaaatatagacctgacagtttatgttatagaatggctttatttactttggtgactgtttatagtttttaaataaaagactgaacattttcttgagtcctttatttctgagtatgcttaagacattctaaaatttaaagtctagctgaaggcaaggtcaaacggtcacctacttactttatactttgtgattgtagagaacagaaaggtgcatcatgtgataggacaccatggtcacggtaggaaggagaccaggagaccaaatgttttgtttacagtagtatgagtagtagccccagagagcgagagacagttagggctcggttgccttactgtgtgtcccgcatctatctgactgagagctttgtttaccattcgactctaggtttcagtttaactaattcaggggcagcttcttggcaatgagcttcagtctggacagttcaaatatcttgattaatttagtaccaaaaagtaatttctccccaggggtctctgtgctctcagctctaactgtaagaaatgtgtggcgacacccagaacttggtattctcaggttggtggcgtttgacttcttcgccttagcctggggctgcccagcagacaccctgagtccaggtaccttactgtatccctcaaatatcgccagactaaaggtttctaagggcagatagttgtagaaatttatattcactgtgtttatctaaaaaaattgaggtttttgaaataatttttgtaacatcactgtttgcttgtcctcaaggtacctttttccttccaaagcaggaaattaccatggtggttagcctttagtagcagaaacgacaggcttaagaaagtggcttccatagtcaccatcctgtcacctcactgaattgcatcctgtagatgtagatttttgtgttaaaatgtataaatgtgtctttagtgcttttaagcaatggtctcagcagaattttctaaatgtatctgacctgacgaaaccaatttctagctccccttaggcttcccctccggcagctttacctgactaatggataagacttggtgggtaacgcggttgaagtgctcttgcagtccagggcctgcagaaccctcgcagtcacgaaaaggtgctccttgctagacagaaacttgctgacttccagtattgttatttttgtctaaagttctgtaaatacaagctttaatgttatctttgagagatctatgtaaataatagtcaagaacatagagactgtacaattctgtgttatatatgtgcctagtgctctgttggcacttaataaattttaagtaacaaaactgatgatcatatagtgaaggcatatttttcttccgacttgagacaggatatgactatatattaatgagactcaataaaccaagccacacatgaaaacttgtctcattactttatagccatgccatgtatgttttttaaactataaaatgacaataaaactgatttttgaaatgagtgttttggataagtgacttctgtcctgatcttataccataaataaagtactgaagacgaaatatgaagctcttacccaaaggagtagctgcttagaaacaagagtgaagcttgaagatcagccacacaggccacctcacactttgttcctgtttatcttacgatacagtaagggaaggcaccatttagagccagcttgtgttagttaaccactctcatactgcccaactcttgactgaactctggcactcaaatacttggagtgagcttccttccaaggccacagaacagagaccaaccgaattaccagctggttccatcatagctagtaaactttatctagcaacaatttccactccctgcattggtttgaaaaaaaaaatgcaaagagacagtatcaatgtatgtaagtggattcactaataatacaaccacactttaagtattaaagtggggtgagatggcttggtct

SEQ ID NO: 12 - protein, 1828 aa, Mus musculus
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSSVFGEEWREKTDRDFVKFWKDIVDDNEVRDLISDRNKAHEDTPGEWIWESLFHPPRKLGINDIEGQRVLQIAVILRNLSFEESNVKLLAANRTCLRFLLLSAHSHFISLRQLGLDTLGNIAAELLLDPVDFRTTHLMFHTVTKCLMSRDRFLKMRGMEILGNLCKAEDNGVLICEYVDQDSYREIICHLTLPDVLLVTSTLEVLYMLTEMGDVACTKIAKVEKSIDVLVCLVSMDAQMFGPDALAAVKLIEHPSSSHQVLSEIRPQAIEQVQTQTHIASGPASRAVVAQHAAPPPGIVEIDSEKFACQWLNAHFEVNPDCSVSRAEMYSEYLSTCSKLARGGILTSTGFYKCLRTVFPNHTVKRVEDSTSSGQAHIHVIGVKRRALPLPIQMYYQQQPISTPVVRVDAVADLSPTPSPAGIPHGPQAAGNHFQRTPVTNQSSNLTATQMSFPVQGIHTVAQTVSRIPPNPSVHTHQQQNSPVTVIQNKAPIPCEVVKATVIQNSVPQTAVPVSISVGGAPAQNSVGQNHSAGPQPVTVVNSQTLLHHPSVMPQPSPLHTVVPGQVPSGTPVTVIQQTVPQSRMFGRVQSIPACTSTVSQGQQLITTSPQPMHTSSQQTAAGSQPQDTVIIAPPQYVTTSASNIVSATSVQNFQVATGQVVTIAGVPSPQPSRVGFQNIAPKPLPSQQVSPSVVQQPIQQPQQPAQQSVVIVSQPAQQGQAYAPAIHQIVLANPAALPAGQTVQLTGQPNITPSSSPSPVPPTNNQVPTAMSSSSTLQSQGPPPTVSQMLSVKRQQQQQHSPAAPAQQVQVQVQQPQQVQVQVQPQQPSAGVGQPAPNESSLIKQLLLPKRGPSTPGGKLILPAPQIPPPNNARAPSPQVVYQVANNQAAGFGVQGQTPAQQLLVGQQNVQLVQSAMPPAGGVQTVPISNLQILPGPLISNSPATIFQGTSGNQVTITVVPNTSFATATVSQGNAAQLIAPAGLSMSGAQASAGLQVQTLPAGQSACTTAPLPFKGDKIICQKEEEAKEATGLHVHERKIEVMENPSCRRGTTNTSNGDTSESELQVGSLLNGRKYSDSSLPPSNSGKLQSETSQCSLISNGPSLELGENGAPGKQNSEPVDMQDVKGDLKKALVNGICDFDKGDGSHLSKNIPNHKTSNHVGNGEISPVEPQGTSGATQQDTAKGDQLERVSNGPVLTLGGSPSTSSMQEAPSVATPPLSGTDLPNGPLASSLNSDVPQQRPSVVVSPHSTAPVIQGHQVIAVPHSGPRVTPSALSSDARSTNGTAECKTVKRPAEDNDRDTVPGIPNKVGVRIVTISDPNNAGCSATMVAVPAGADPSTVAKVAIESAAQQKQQHPPTYMQSVAPQNTPMPPSPAVQVQGQPSSSQPSPVSASSQHADPVRKPGQNFMCLWQSCKKWFQTPSQVFYHAATEHGGKDVYPGQCLWEGCEPFQRQRFSFITHLQDKHCSKDALLAGLKQDEPGQVANQKSSTKQPTVGGTGSAPRAQKAIASHPSAALMALRRGSRNLVFRDFTDEKEGPITKHIRLTAALILKNIGKYSECGRRLLKRHENNLSVLAISNMEASSTLAKCLYELNFTVQSKEQEKDSEML

SEQ ID NO: 13 - DNA, 2330 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 14 - protein, 652 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEQITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 15 - DNA, 2327 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 16 - protein, 651 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 17 - DNA, 2370 bp, Mus musculus
ggtttgccggcctctcgccctctcgccactggtgtcgcgcttcggtcgcgtcccgcgcgtggttttttttttttctcgtgagggacctcgcgccgccgggcgcgtgccgtccccctgcctcgcggcgcgggctctcgcgggccccgctcccgccctccgctcgcctggcccggaccggaagcggcgccgcacggcctgggcctggcgcggggggcgggctctggggcccggtcggacatgggcaagaagcacaagaagcacaagtcggaccgccacttctacgaggagtacgtggagaagcccctgaagctggtcctcaaagtcggggggagcgaggtcaccgagctctccacgggcagctccgggcacgactccagcctcttcgaagacagaagcgaccatgacaaacacaaggacagaaaacggaaaaagaggaagaaaggcgagaagcaggctccgggggaagagaaggggagaaaacggagaagagtcaaggaggataaaaagaagcgggatcgagaccgtgcagagaatgaggtggacagagatctccagtgtcatgtccctataagattagacttacctcctgagaagcctcttacaagctcgttagccaaacaagaagaagtagaacagacaccccttcaggaagctttgaatcagctcatgagacaattgcaaagaaaagacccaagtgctttcttttcatttcctgtgacggattttattgcgcctggctactccatgattattaaacacccaatggattttagtaccatgaaagaaaagatcaagaataacgactaccagtccatagaagaactaaaggataacttcaagctaatgtgtactaatgcaatgatttacaataagccagagaccatttattataaagctgcaaagaagctgttgcactcagggatgaaaattctcagtcaggagagaattcagagcctgaagcagagtatagacttcatgtcagacttgcagaaaactcggaagcagaaagaacgaacagatgcctgtcagagtggggaggacagcggctgctggcagcgcgagagggaagactctggagatgctgaaacacaggccttcagaagccccgctaaggacaataaaaggaaagacaaagatgtgcttgaagacaaatggagaagcagcaactcagaaagggagcatgagcagattgagcgcgttgtccaggagtcaggaggcaagctaacacggcggctggcaaacagtcagtgtgaatttgaaagaagaaaaccagatgggacaacaacactggggcttctccatcctgtggatcccattgtgggagagccaggctactgccctgtgagattggggatgacaactggaagactgcagtctggagtgaacactctgcaggggttcaaagaggataaaaggaacagagtaaccccagtattatacttgaattatggaccctacagttcttatgccccacattatgactctacatttgccaatattagcaaagatgattctgatttaatctactcaacatatggggaagactctgaccttccaaacaatttcagcatctctgagtttttggccacatgccaagattacccgtatgttatggcagatagtttactggatgttctaacaaaaggaggacattccaggagcctgcaggacttggacatgtcatctcctgaagatgaaggccagaccagagcattggacacagcaaaagaagcagagattacacaaatagagccaacagggcgtttggagtccagcagtcaggacaggctcacagcactgcaagctgtaacaacctttggtgctccagctgaagtctttgactccgaagaggctgaggtgttccagaggaagcttgatgagacgacaagattgctcagggagctccaggaggcacagaatgagcgactgagcactaggcctcctcccaatatgatctgtctcctgggtccttcttacagagaaatgtaccttgctgaacaagtgaccaataacctcaaagaactcacacagcaagtgactccaggtgatgttgtaagcatacacggagtgcgaaaagcaatggggatttctgttccttcccccatcgtgggaaacagcttcgtagatttgacaggagagtgtgaagaacctaaggagaccagcactgctgagtgtgggcctgacgcgagctgaactagcctggtatttgattctattatgtacatagtttttcattctgaacttggaggtgcttttcagaagatattaactatttgtaaattgtgttttaattaagctttgggacagttccttttaatgttccaaagattggccttgtattaggaaataaagctgaacctgggactgtga

SEQ ID NO: 18 - protein, 651 aa, Mus musculus
MGKKHKKHKSDRHFYEEYVEKPLKLVLKVGGSEVTELSTGSSGHDSSLFEDRSDHDKHKDRKRKKRKKGEKQAPGEEKGRKRRRVKEDKKKRDRDRAENEVDRDLQCHVPIRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMSDLQKTRKQKERTDACQSGEDSGCWQREREDSGDAETQAFRSPAKDNKRKDKDVLEDKWRSSNSEREHEQIERVVQESGGKLTRRLANSQCEFERRKPDGTTTLGLLHPVDPIVGEPGYCPVRLGMTTGRLQSGVNTLQGFKEDKRNRVTPVLYLNYGPYSSYAPHYDSTFANISKDDSDLIYSTYGEDSDLPNNFSISEFLATCQDYPYVMADSLLDVLTKGGHSRSLQDLDMSSPEDEGQTRALDTAKEAEITQIEPTGRLESSSQDRLTALQAVTTFGAPAEVFDSEEAEVFQRKLDETTRLLRELQEAQNERLSTRPPPNMICLLGPSYREMYLAEQVTNNLKELTQQVTPGDVVSIHGVRKAMGISVPSPIVGNSFVDLTGECEEPKETSTAECGPDAS

SEQ ID NO: 19 - DNA, 1692 bp, Homo sapiens
ggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaa

SEQ ID NO: 20 - protein, 498 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 21 - DNA, 1686 bp, Homo sapiens
ggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaa

SEQ ID NO: 22 - protein, 496 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 23 - DNA, 1665 bp, Mus musculus
gcggcggcggccgctgggactaggcgaaggcggcgacgacgacggaggcgcggggcgcttgggctgatggcagcggccgggcccggggcggcgctgtccccggggcggtgcgacagcgacccggcctcccccggagcgcagtccccaaaggatgataatgaagataactcaaatgatgggacccatccatgtaaaaggaggcgaatgggctcaggagacagctcaagaagttgtgagacttcaagtcaagatcttagcttcagttactacccagcagaaaacttaatcgaatacaaatggccacctgatgaaacaggagaatactatatgcttcaggagcaagtcagtgaatatctgggtgtgacctccttcaagcggaaatatccagatttagagcgacgagatttatctcacaaggagaaactatacctgagagaattaaacgtcatcacggaaacacagtgcacactgggtttaacagcattgcgcagtgatgaagtgattgacttaatgataaaagaatatccagctaaacacgctgaatattcggttatcctacaagaaaaggaacgtcagagaattacagatcattataaagagtattctcaaatgcaacaacagagtactcagaaagtcgaagccagcaaagtacctgagtacattaagaaagcagccaagaaggcagctgagttcaacagcaacttaaaccgggagcgcatggaagaaagaagagcctattttgacttacagacacatgttatccaagtgcctcaaggaaagtacaaagtgttgccgacagaccgaacgaaggtcagttcctacccagtggctctcatcccgggacagttccaggagtattataagaggtactcaccagatgagcttcggtacttgccattaaacacagccctgtatgagccgcccctggacccagagctcccggcactagatagtgatggagactcagatgatggcgaagatggcggaggggatgagaagcggaagaataaaggcacttcggacagctcctcaggcaatgtgtctgaaggagacagcccccctgacagccaggaggacaccttccacggaagacagaaatcaaaagacaaaatggccactccaagaaaagacggctccaaacgttctgtactgtccaaatcagctcctgggtacaagccaaaggtcattccaaatgctctatgtggaatttgtctgaagggtaaggagtccaacaagaaaggaaaggctgaatcacttatacactgctcccagtgtgataacagtggccacccttcttgcttggatatgaccatggagcttgtttctatgattaagacctacccatggcagtgtatggaatgtaagacatgcattatatgtggacagccccaccatgaagaagaaatgatgttctgtgatgtgtgtgacagaggttatcatactttttgtgtgggccttggtgctattccttcaggtcgctggatttgtgactgttgtcagcgagctcccccaacacccaggaaagtgggcagaagggggaaaaacagcaaagaggggtaaaataggctttgaccctcatgtttgggatatttggtgccaatttatttacaacactttcatttttatgccaataaaaacttttttgaaattaacgatgaccttaaa

SEQ ID NO: 24 - protein, 497 aa, Mus musculus
MAAAGPGAALSPGRCDSDPASPGAQSPKDDNEDNSNDGTHPCKRRRMGSGDSSRSCETSSQDLSFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQSTQKVEASKVPEYIKKAAKKAAEFNSNLNRERMEERRAYFDLQTHVIQVPQGKYKVLPTDRTKVSSYPVALIPGQFQEYYKRYSPDELRYLPLNTALYEPPLDPELPALDSDGDSDDGEDGGGDEKRKNKGTSDSSSGNVSEGDSPPDSQEDTFHGRQKSKDKMATPRKDGSKRSVLSKSAPGYKPKVIPNALCGICLKGKESNKKGKAESLIHCSQCDNSGHPSCLDMTMELVSMIKTYPWQCMECKTCIICGQPHHEEEMMFCDVCDRGYHTFCVGLGAIPSGRWICDCCQRAPPTPRKVGRRGKNSKEG

SEQ ID NO: 25 - DNA, 4206 bp, Homo sapiens
atgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttga

SEQ ID NO: 26 - protein, 1401 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 27 - DNA, 4275 bp, Mus musculus
atgaaatcctgcggagtgtcgctcgctaccgccgccgccgccgccgccgccgccgctttcggtgatgaggaaaagaaaatggcggcgggaaaagcgagcggcgagagcgaggaggcgtcccccagcctgacagcggaggagagggaggcgctcggcggactggacagccgccttttcgggttcgtgaggtttcatgaagatggcgccaggatgaaggccctgctgggcaaggctgttcgctgctacgaatctctaatcttaaaagctgaagggaaagtggagtctgatttcttttgtcaattaggtcacttcaacctcttattggaagattatccaaaagcattatctgcataccagaggtactacagtttacagtctgattactggaagaatgctgcctttttatatggtcttggtttggtctacttccattacaatgcatttcagtgggctattaaagcatttcaggaggtgctttatgtcgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcagtttcacattgcccacttatatgaaacccagaggaagtatcattctgcaaaagaagcttatgagcaacttttgcagacagaaaacctttctgcacaagtaaaagcaactattttacaacaattaggttggatgcatcacactgtggatctcctgggagataaggccaccaaggaaagttatgctattcagtatctccagaagtccttggaagcagatccaaattctggccagtcctggtatttccttggaaggtgctattcaagtattgggaaagttcaggatgcctttatatcttacaggcaatctattgataaatcagaagcaagtgcagatacatggtgttcaataggtgtgctctatcaacagcaaaatcagcctatggatgctttgcaagcttatatttgtgctgtacaattggaccacggtcatgctgcagcctggatggatctaggcactctctatgaatcctgcaaccaacctcaggatgctattaaatgctatttaaatgcaactagaagcaaaaattgtagtaatacctctggacttgcagcacgaattaagtatttacaggctcagttgtgtaaccttccacaaggtagtctacagaataaaactaaattacttcctagtattgaggaggcatggagcctaccaatccccgcagagcttacctccaggcagggtgccatgaacacagcacagcagaatacttctgataattggagtggtggcaatgcaccacctccagtagaacaacaaactcattcatggtgtttgacaccacagaaattacagcacttggaacagctccgagcaaacagaaataatttaaatccagcacagaaactaatgctggaacagctggaaagtcagtttgtcttaatgcagcaacaccaaatgagacaaacaggagttgcacaggtacggcctactggaattcttaatgggccaacagttgactcatcactgcctacaaactcagtttctggccagcagccacagcttcctctgaccagaatgcctagtgtctctcagcctggagtccacactgcctgtcctaggcagactttggccaatggacccttttctgcaggccatgttccctgtagcacatcaagaacactgggaagtacagacactgttttgataggcaataatcatgtaacaggaagtggaagtaatggaaacgtgccttacctgcagcgaaacgcacccactctacctcataaccgcacaaacctgaccagcagcacagaggagccgtggaaaaaccaactatctaactccactcaggggcttcacaaaggtccgagttcacatttggcaggtcctaatggtgaacgacctctatcttccactgggccttcccagcatctccaggcagctggctctggtattcagaatcagaatggacatcccaccctgcctagcaattcagtaacacagggggctgctctcaatcacctctcctctcacactgctacctcaggtggacaacaaggcattaccttaaccaaagagagcaagccttcaggaaacacattgacggtgcctgaaacaagcaggcaaactggagagacacctaacagcactgccagtgttgagggacttcctaatcatgtccatcaggtgatggcagatgctgtttgcagtcctagccatggagattctaagtcaccaggtttactaagttcagacaatcctcagctctctgccttgttgatgggaaaagctaataacaatgtgggtcctggaacctgtgacaaagtcaataacatccacccaactgtccatacaaagactgataattctgttgcctcttcaccatcttcagccatttccacagcaacaccttctcctaagtccactgaacagacaaccacaaacagtgttaccagccttaacagccctcacagtgggctgcacacaattaatggagaaggaatggaagaatctcagagccccattaaaacagatctgcttctagttagccacagacctagtcctcagatcataccatcaatgtctgtgtccatatatcccagctcagcagaagttctgaaagcttgcaggaatctaggtaaaaacggcctgtctaatagtagcattctgttggataaatgtccgcctccaagaccaccatcctcaccataccctcccttgccaaaggacaagttgaatccacctacacctagtatttatttggaaaataaacgtgatgctttctttcctccattacatcaattttgtacaaacccaaacaaccctgttacagtaatacgtggccttgctggagctcttaaattagacttgggacttttctctactaaaactttggtggaagctaacaatgaacatatggtagaagtgaggacacagttgttacaaccagcagatgaaaattgggaccctactggaaccaagaaaatctggcactgtgaaagtaatagatctcatactacaattgctaaatatgctcagtaccaggcctcctcattccaagaatcattgagagaagaaaatgagaaaagaagtcaccataaagaccactcagacagtgaatctacatcatcagataattctgggaaaagaagaaaaggaccctttaaaaccattaagtttgggaccaacattgacctgtctgatgacaaaaagtggaagttacagctacatgagctgactaaacttcctgccttcgtgagagttgtatctgcaggaaatcttttaagccacgttggtcatactatactgggcatgaacacagttcaactatacatgaaagttccaggaagcagaacaccaggtcatcaagaaaataacaacttctgttcagttaatataaatattggcccaggtgactgtgaatggtttgttgttcctgaaggctactggggtgttttgaatgacttctgtgaaaaaaataatttgaatttcttaatgggttcttggtggcccaaccttgaagatctatatgaagcaaatgttccagtgtataggtttattcagcgacctggagatctggtctggataaatgctggcactgttcattgggttcaagctattggctggtgcaacaatattgcttggaatgttggtccacttacagcctgtcagtataagttagcagtggaacgttatgaatggaacaagttgcaaaatgtaaagtcaatagtacccatggttcatctttcctggaatatggcacgaaatatcaaggtttcagatccaaagctttttgaaatgattaagtattgtcttctgagaacgctgaagcaatgtcagacattgagggaagctctaattgctgcaggaaaagagatcatatggcacgggcggacaaaagaagaaccagctcattattgtagtatttgtgaggtggaggtttttgatctgctttttgtcactaatgagagtaattctcgaaaaacctacatagtacattgccaagattgtgcacgaaaaacaagtgggaatctggaaaattttgtggtgctagaacagtacaaaatggaggatctgatgcaagtctatgaccaatttacattagtaagtgaaatcaacatgctcctccattaccatccgcctcatcttgatattgttccatggacattaaacatgagaccttttctgctattcagaaagtaa

SEQ ID NO: 28 - protein, 1424 aa, Mus musculus
MKSCGVSLATAAAAAAAAAFGDEEKKMAAGKASGESEEASPSLTAEEREALGGLDSRLFGFVRFHEDGARMKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATILQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKNCSNTSGLAARIKYLQAQLCNLPQGSLQNKTKLLPSIEEAWSLPIPAELTSRQGAMNTAQQNTSDNWSGGNAPPPVEQQTHSWCLTPQKLQHLEQLRANRNNLNPAQKLMLEQLESQFVLMQQHQMRQTGVAQVRPTGILNGPTVDSSLPTNSVSGQQPQLPLTRMPSVSQPGVHTACPRQTLANGPFSAGHVPCSTSRTLGSTDTVLIGNNHVTGSGSNGNVPYLQRNAPTLPHNRTNLTSSTEEPWKNQLSNSTQGLHKGPSSHLAGPNGERPLSSTGPSQHLQAAGSGIQNQNGHPTLPSNSVTQGAALNHLSSHTATSGGQQGITLTKESKPSGNTLTVPETSRQTGETPNSTASVEGLPNHVHQVMADAVCSPSHGDSKSPGLLSSDNPQLSALLMGKANNNVGPGTCDKVNNIHPTVHTKTDNSVASSPSSAISTATPSPKSTEQTTTNSVTSLNSPHSGLHTINGEGMEESQSPIKTDLLLVSHRPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGKRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQNVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLVSEINMLLHYHPPHLDIVPWTLNMRPFLLFRK

SEQ ID NO: 29 - DNA, 8585 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 30 - protein, 2285 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 31 - DNA, 7874 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 32 - protein, 2068 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 33 - DNA, 8175 bp, Mus musculus
atggccgcgcaggtcgcccccgccgccgccagcagcctgggcaacccgccgccgccgccctcggagctgaagaaagccgagcagcaacagcgggaggaggcggggggcgaggcggcggcggcagcggccgagcgcggggaaatgaaggcagccgccgggcaggagagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcccggagccgcccggcggcggcggcggcggcggcagcagcagcagcgacggggtgggggcgcctcctcactcggccgcggccgccctgccgcccccagcctacggcttcgggcaagcctacggccggagcccgtctgccgtcgccgccgcggcggccgccgtcttccaccaacaacatggcggacaacaaagccctggcctggcagcgctgcagagcggcggcggcgggggcttggagccctacgccgggccccagcagaactcgcacgaccacggcttccccaaccaccagtacaactcctactaccccaaccgcagcgcctaccccccgcctccccaggcctacgcgctgagctccccgagaggtggcactccgggctccggcgcggcggcggccgccggctccaagccgcctccctcctccagcgcctctgcctcctcgtcgtcttcgtccttcgcacagcagcgcttcggggccatggggggaggcggcccctcagcggccggcgggggaactccccagcccaccgccacccccaccctcaaccaactgctcacgtcgcccagctcggcccgtggctaccagggctaccccgggggcgactacggcggcgggccccaggacgggggcgcgggcaaaggcccggcggacatggcctcgcagtgctggggggctgcggcggcggcggcggcggcggcagcggccgtctcgggaggggcccaacaaaggagccaccacgcgcccatgagccccgggagcagcggcggcggggggcagccgctcgcccggacccctcagtcatccagtccaatggatcagatgggaaagatgagacctcagccgtatggtgggactaacccatactcgcaacaacagggacctccttcaggaccgcaacaaggacatgggtacccagggcagccatatgggtcccagactccacagcggtaccccatgaccatgcagggccgggctcagagtgccatgggcagcctctcttatgcacagcagattccaccttatggccagcaaggccccagtgcgtatggccagcagggccagactccatactataaccagcaaagtcctcatccccagcagcagccaccttacgcccagcaaccaccatcccagacccctcatgcccagccttcgtatcagcagcagccgcagactcagcaaccacagcttcagtcctctcagcctccatattcccagcagccatcccagcctccacatcagcagtccccaactccatatccctcccagcagtccaccacacaacagcatccccagagccagcccccctactcacaaccacaggcacagtctccctaccagcagcagcaacctcagcagccagcatcctcgtcgctctcccagcaggctgcatatcctcagccccagcctcagcagtcccagcaaactgcctattcccagcagcgcttccctccaccacaggagctttctcaagattcatttgggtctcaggcatcctcagccccctcaatgacctccagtaagggagggcaagaagatatgaacctgagtcttcagtcaaggccctccagcttgcctgatctgtctggttcaatcgatgatctccccatggggacagaaggagctctgagtcctggcgtgagcacatcagggatttccagcagccaaggagagcagagcaatccagctcagtctcccttttctcctcacacctcccctcacctgcctggcatccgaggcccgtccccgtcccctgttggctctcctgccagtgtcgcgcagtctcgctcaggaccactctcgcctgctgcagtgccaggcaaccagatgccacctcggccacccagtggccagtcagacagcatcatgcacccttccatgaaccaatcaagcattgcccaagatcgaggttatatgcagaggaacccccagatgccccagtacacttcccctcagcctggctcggccttatccccacgtcagccgtctggaggacagatgcactcgggcgtgggctcctaccagcagaactccatggggagctacggcccccagggcagtcagtatggcccacaaggaggctatcctaggcagcctaactataatgccttgcccaacgccaactaccccaatgcaggcatggccggaagtatgaaccctatgggtgctggaggtcagatgcatgggcagcctggaatcccaccttacggcacactccctccagggagaatggctcatgcgtctatgggcaacaggccctatggccctaatatggccaatatgccacctcaggttgggtcagggatgtgtcctccaccagggggaatgaacaggaaaactcaagagtctgctgttgccatgcatgttgctgccaactctatccaaaacaggccaccaggctacccaaatatgaatcaagggggcatgatgggaactggacctccctatggacaggggatcaatagtatggctggcatgatcaaccctcagggacccccatatcctatgggtggaaccatggccaacaattcagcagggatggcagccagcccagagatgatgggccttggggatgttaagttaactcccgccacaaaaatgaacaacaaggcagatggaacacccaagacagaatccaaatctaagaaatccagttcttctaccaccaccaatgagaagatcaccaaattgtatgagttgggtggtgagcccgagaggaagatgtgggtggaccggtacctggccttcacagaggagaaggccatgggcatgacaaatctgcctgctgtggggaggaagcctctggacctctatcgcctctatgtgtctgtgaaggagattggtgggttgactcaggtcaacaagaacaaaaaatggcgggaacttgcaaccaacctcaatgtgggtacatcaagcagtgctgccagctcactgaaaaagcagtatatccaatgtctctatgcctttgagtgcaagatcgagcgtggagaagaccctccccccgatatcttcgcagctgctgactccaagaagtcccaacccaagatccagcccccctctcctgcgggatcagggtctatgcaggggccacaaactcctcagtcaaccagcagttctatggcagaaggaggagacctgaagccaccaactccagcatccacaccacatagtcaaattccccccttaccaggcatgagcaggagcaactcagtcggaatccaggatgcctttcctgatggaagtgaccccacattccagaagcggaattccatgactccaaaccctgggtaccagcccagtatgaatacctctgacatgatggggcgcatgtcctatgagccaaataaggatccttatggcagcatgaggaaagcgccaggaagtgatcccttcatgtcctcagggcagggccccaatggcgggatgggtgatccctacagccgtgctgctggccctgggctgggaagtgtggcgatgggaccacggcagcactatccctatggaggtccttacgacagagtgaggacggagcctggaatcgggcctgaaggaaatatgggcactggagcccctcagccaaatctcatgccttccaccccagattcggggatgtattctcctagccgctaccccccgcagcagcagcagcaacagcagcaacaacatgattcctatggcaatcaattctctacccaaggcaccccttccagcagccccttccccagccagcagaccacaatgtatcagcagcagcagcagaattataagaggccaatggatggcacatatggcccccctgccaagcggcatgaaggggagatgtacagtgtgccgtacagcgctgggcaaggccagcctcaacagcagcagttgcctgcagctcagtcccagcctgccagccagccacaagctgcccagccttcccctcagcaggacgtgtacaaccagtacagcaatgcctaccctgcctccgccaccgctgctactgatcgccgaccagcaggcggcccccagaaccaatttccattccagtttggccgagaccgagtctctgcacctcctggttccagtgcccagcagaacatgccaccacaaatgatgggtggccccatacaggcatcagctgaggttgctcagcagggcaccatgtggcaggggcgaaatgacatgacctacaattatgccaacaggcagaacacaggctctgccacccagggccctgcgtatcatggtgtgaaccgaacagatgaaatgctccacacagatcagagggccaaccatgaaggcccatggccttcccatggcacacgccagcctccgtatggtccttcagcccctgttccccccatgacaaggccccctccatctaactaccagcccccaccaagcatgccgaatcacattcctcaggtatccagccccgctcccctcccccggcccatggagaaccgtacttctcctagcaagtctccattcctgcactctgggatgaaaatgcaaaaggcgggtccaccggtgcctgcttcgcacatagcgcctacccctgtgcagccgcctatgattcggcgggatatcaccttcccacctggctctgtagaggccactcagcctgtgttgaagcagagaaggcggctcacaatgaaagacattggaaccccggaggcatggcgggtaatgatgtccctcaagtccgggctcctggcagagagcacgtgggcgttagacaccattaacattctactgtatgatgacaacagcattatgaccttcaacctcagccagctcccaggcttgctagagctccttgtggaatatttccgtagatgcctaattgaaatctttggcattttaaaggagtatgaggtaggggacccaggacagagaacattactagaccctgggagattcaccaaggtgtatagtccagcccatacagaggaagaagaggaagaacaccttgatcctaaactggaggaggaagaggaagaaggggttggaaatgatgaggagatggcctttttgggcaaggacaagccatcttcagagaataatgaggagaagctagtcagtaagtttgacaagcttccggtaaagatcgtgcagaggaatgacccatttgtggtggactgctcagataagcttgggcgcgtgcaggagtttgacagtggcctgctacactggcggattggtggtggggataccactgagcatatccagacccactttgagagcaagatagagctgctgccttcccggccttatgtgccctgcccaacgccccctcggaaacacctcacaacagtagagggcacaccagggacaacggagcaggagggccccccgcccgatggccttccagagaaaaggatcacagccaccatggatgacatgttgtctacccggtctagcacattgactgatgagggggcaaagagtgcagaggccaccaaggaaagcagcaagtttccatttggcattagcccagcacagagccaccggaacatcaaaattttagaggatgaaccccatagtaaggatgagaccccactgtgtacccttctggactggcaggattcccttgctaagcgctgtgtctgtgtctccaataccatccggagcctgtcgtttgtgccaggcaacgactttgagatgtccaaacacccagggctgctgcttatcctgggcaagctgatcctgctgcaccacaagcacccagagcggaagcaggcaccactaacttatgagaaggaggaggaacaggaccaaggggtgagctgtgacaaagtggagtggtggtgggactgcttggagatgctccgagaaaacacgctggtcaccctcgccaacatctcggggcaattggacctatccccatatcctgagagcatctgcctgcctgtcctggacggactcctacactgggcagtttgcccttcagctgaagcccaggaccccttctcaaccctaggccccaatgccgtcctctccccccagagattggtcttggaaaccctcagcaaactcagcatccaggacaacaatgtggacctgatcctggccactcccccttttagccgcctggagaagttgtatagtaccatggtgcgcttcctcagtgaccgaaagaacccagtgtgccgggagatggccgtggtactgctggcaaatctggcccagggggacagcctggcagcccgggccattgcagtgcagaagggcagcatcggcaacctcctgggtttcctggaggacagccttgctgccacacagttccagcagagccaggcaagcctcctgcatatgcagaatccaccctttgaaccaactagtgtggacatgatgcggcgggctgcccgagcactgcttgccctggccaaggtggatgagaaccactcagagttcactctgtatgagtcacggctgttggacatctccgtgtcaccactgatgaactcattggtttcacaagtcatttgtgatgtactgtttttgattggccagtcatgacagccgtgggacacctcccctccccgtgtgtgtgtgagtgtgtggagaacttagaaactgactgttgccctttatttatgcaaaaccacctcagaatccagtttaccctgtgctgtccagcttctcccttgggaaagcctctcctgttctctctcctccccaccctcactccctcacacctttctgttccccatcctcacctgcttccctcaggaccccaccctatttgaaaagacaaagctctgcctacatagaagacttttttattttaaccaaagttactgttgtttacagtgagtttggggaaaaaaatggctttcccagtccttgcatcaacgggatgccacatttcataactgtttttaatggttaaaaaaaaaaaaaaaaaaaggaaaaaaaatacaaaaaaaccctgaaggacaaaggtgactgctgagctgtgtggtttgtcgctgtccattcacaatctcgcaggagccgagaagttcgcagttgtgagcagaccctgttcactggagaggcctgtgcagtagagtgtagatcctttcatgtactgtactgtacacctgatactgtaaacatactgtaataataatgtctcacatggaaacgagagaagacgctgggtcagcagcaagctgtagtttttaaaaatgtttttagttaaatgttgaggagaaaaaaaatggctttccccccaaagtatcctgtgtgaacctacaacgccctgacctctttctctcctccttgattgtatgaatagccctgagatcacctcttagacctggttttaacctttagctgcagcggctgcgctgccacgtgtgtatatatatgatgttgtacattgcacatacccttgaatctccacagtttggtccccttcccagctacccctttatagtatggcgagttaacaagttggtgacctgcacaaagcgagacacagctatttaatctcttgccagacattgcccctcttggtgcagtgctctacaggtctctgtaaaaagcccttgctgtctcagcagccaatcaacttacagtttatttttttctgggtttttgttttgttttgtttcatttctaatcgaggtgtgaaaaagttctaggttcagttgaagttcctgatgaagaaacacaattgagattttttcagtgataaaatctgcatatttgtatttcaacaatgtagctaaaaacttgatgtaaattcctccttttttttccttttttggcttaatgaatatcatttattcagtatgaaatctttatactatatgttccacgtgttaagaataaatgtacattaaatcttggtaa

SEQ ID NO: 34 - protein, 2283 aa, Mus musculus
MAAQVAPAAASSLGNPPPPPSELKKAEQQQREEAGGEAAAAAAERGEMKAAAGQESEGPAVGPPQPLGKELQDGAESNGGGGGGGAGSGGGPGAEPDLKNSNGNAGPRPALNNNLPEPPGGGGGGGSSSSDGVGAPPHSAAAALPPPAYGFGQAYGRSPSAVAAAAAAVFHQQHGGQQSPGLAALQSGGGGGLEPYAGPQQNSHDHGFPNHQYNSYYPNRSAYPPPPQAYALSSPRGGTPGSGAAAAAGSKPPPSSSASASSSSSSFAQQRFGAMGGGGPSAAGGGTPQPTATPTLNQLLTSPSSARGYQGYPGGDYGGGPQDGGAGKGPADMASQCWGAAAAAAAAAAAVSGGAQQRSHHAPMSPGSSGGGGQPLARTPQSSSPMDQMGKMRPQPYGGTNPYSQQQGPPSGPQQGHGYPGQPYGSQTPQRYPMTMQGRAQSAMGSLSYAQQIPPYGQQGPSAYGQQGQTPYYNQQSPHPQQQPPYAQQPPSQTPHAQPSYQQQPQTQQPQLQSSQPPYSQQPSQPPHQQSPTPYPSQQSTTQQHPQSQPPYSQPQAQSPYQQQQPQQPASSSLSQQAAYPQPQPQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYTSPQPGSALSPRQPSGGQMHSGVGSYQQNSMGSYGPQGSQYGPQGGYPRQPNYNALPNANYPNAGMAGSMNPMGAGGQMHGQPGIPPYGTLPPGRMAHASMGNRPYGPNMANMPPQVGSGMCPPPGGMNRKTQESAVAMHVAANSIQNRPPGYPNMNQGGMMGTGPPYGQGINSMAGMINPQGPPYPMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFPDGSDPTFQKRNSMTPNPGYQPSMNTSDMMGRMSYEPNKDPYGSMRKAPGSDPFMSSGQGPNGGMGDPYSRAAGPGLGSVAMGPRQHYPYGGPYDRVRTEPGIGPEGNMGTGAPQPNLMPSTPDSGMYSPSRYPPQQQQQQQQQHDSYGNQFSTQGTPSSSPFPSQQTTMYQQQQQNYKRPMDGTYGPPAKRHEGEMYSVPYSAGQGQPQQQQLPAAQSQPASQPQAAQPSPQQDVYNQYSNAYPASATAATDRRPAGGPQNQFPFQFGRDRVSAPPGSSAQQNMPPQMMGGPIQASAEVAQQGTMWQGRNDMTYNYANRQNTGSATQGPAYHGVNRTDEMLHTDQRANHEGPWPSHGTRQPPYGPSAPVPPMTRPPPSNYQPPPSMPNHIPQVSSPAPLPRPMENRTSPSKSPFLHSGMKMQKAGPPVPASHIAPTPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFTKVYSPAHTEEEEEEHLDPKLEEEEEEGVGNDEEMAFLGKDKPSSENNEEKLVSKFDKLPVKIVQRNDPFVVDCSDKLGRVQEFDSGLLHWRIGGGDTTEHIQTHFESKIELLPSRPYVPCPTPPRKHLTTVEGTPGTTEQEGPPPDGLPEKRITATMDDMLSTRSSTLTDEGAKSAEATKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCDKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 35 - DNA, 9609 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaaaaaaaaaaaa

SEQ ID NO: 36 - protein, 2236 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 37 - DNA, 9648 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggactctggagatgccacatggaaagaaacattctggttgatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaaaaaaaaaaaa

SEQ ID NO: 38 - protein, 2249 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 39 - DNA, 9833 bp, Homo sapiens
gggggcggcggcgacggcggcggcggcctgaacagtgtgcaccaccaccccctgctcccccgtcacgaactcaacatggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaa

SEQ ID NO: 40 - protein, 2289 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 41 - DNA, 11325 bp, Mus musculus
tcggcgggccccggctcgaccatggagaccgggctgctccccaaccacaaactgaaagccgttggcgaggcccccgctgcaccgccccatcagcagcaccaccaccaccatgcccaccaccaccaccaccaccatgcccaccacctccaccacctccaccaccaccacgcactacagcagcagctaaaccagttccagcagccgcagccgccgcagccacagcagcagcagccgccgccaccgccgcagcagcagcatcccactgccaacaacagcctgggcggtgcgggcggcggcgcgcctcagcccggcccggacatggagcagccgcaacatggaggcgccaaggacagtgtcgcgggcaatcaggctgacccgcagggccagcctctgctgagcaaaccgggcgacgaggacgacgcgccgcccaagatgggggagccggcgggcagccgctatgagcacccgggcctgggcgcgcagcagcagcccgcgccggtcgccgtgcccgggggcggcggcggcccagcggccgtctcggagtttaataattactatggcagcgctgcccctgctagcggcggccccggcggccgcgctgggccttgctttgatcaacatggcggacaacaaagccccgggatggggatgatgcactccgcctctgccgccgccggggcccccagcagcatggaccccctgcagaactcccacgaagggtaccccaacagccagtacaaccattatccgggctacagccggcccggcgcgggcggcggcggcggcggcggcggaggaggaggaggcagcggaggaggtggaggaggaggaggagcaggaggagcaggaggagcagcggcagcggcagcaggagccggagctgtggcggcggcggccgcggcggcggcggcagcagcagcagcagcaggaggaggcggtggcggcggctatgggagctcgtcctcggggtacggggtgctgagctccccgcggcagcagggcggcggcatgatgatgggccccgggggcggcggggccgcgagcctcagcaaggcggccgccggcgcggcggcggcggcggggggcttccagcgcttcgccggccagaaccagcacccgtcgggggctacaccgaccctcaaccagctgctcacctcacccagccccatgatgaggagctacggcggtagctaccccgactacagcagctccagcgcgccgccgccgccgtcgcagccccagtcccaggcggcggcgggggcggcggcgggtggccagcaggcggccgcgggcatgggcttgggcaaggacctaggcgcccagtacgccgctgccagcccggcctgggcggccgcgcaacaaaggagtcacccggcgatgagccccggcacccccggaccgaccatgggcagatcccagggcagcccgatggacccaatggtgatgaagagacctcagttgtatgggatgggtactcacccccactcccagccacagcagagcagcccatacccaggaggctcctacggtcccccaggtgcacagcggtatccccttggcatgcagggccgggctccaggggccctgggaggcttgcagtacccgcagcagcagatgccaccgcagtacggacagcaagctgtgagtggctactgccagcaaggccagcagccatactacaaccagcagccgcagccctcgcacctcccgccccaggcacagtacctgcagccggcggcggcgcagtcccagcagaggtaccagccacagcaggacatgtctcaagaaggctatggaactagatctcagcctcctctggcccctggaaaatccaaccatgaagacttgaatttaattcaacaggaaagaccatcgagtctaccagacctgtctggctccatcgatgacctccccacgggaacagaagcaactctgagctcagcagtcagtgcatccgggtctacaagcagccagggagatcagagcaacccagcgcagtctcctttctccccacatgcatcacctcacctctccagcatccctggagggccgtcaccttctcctgttggctctcctgtgggaagcaaccaatcgaggtctggtccgatctcccctgcgagtattccaggtagccagatgcctccgcaaccacctggaagccagtcagaatccagttcccatcctgccttgagccagtcaccaatgccacaggaaagaggttttatgacaggcactcagagaaaccctcagatgtctcagtacggacctcagcagacaggaccatccatgtcgcctcacccatctcctgggggccagatgcatcctgggatcagtaactttcagcagagtaactcaagtggcacgtacggcccacagatgagccagtatggaccccaaggcaactactccagaaccccaacatatagcggggtacccagtgcaagctacagcggcccagggcccggtatgggcatcaatgccaacaaccagatgcatggacaagggccagcccagccatgtggtgctatgcccctgggacgaatgccttcagctgggatgcagaacagaccatttcctggaaccatgagcagcgtcacccccagttctcctggcatgtctcaacagggagggccaggaatgggcccaccaatgcccactgtgaaccggaaggcccaggaagctgccgcagctgtgatgcaggctgctgcaaactcagcacaaagcaggcaaggcagttttcctggcatgaaccagagtggcctggtggcctccagctctccctacagccagtccatgaacaacaactccagcctgatgagcacccaggcccagccctacagcatgacgcccacaatggtgaacagctccacagcatctatgggtcttgcagatatgatgtctcccagtgagtccaaattgtctgtgcctcttaaagcagatggtaaagaagaaggcgtgtcccagcctgagagcaagtcaaaggacagctatggctctcagggcatttcccagcctccaaccccaggcaacctgcctgtcccttccccaatgtctcccagctctgccagcatctcctcctttcatggagatgagagtgacagcattagcagcccaggctggcccaagacaccatcaagccctaagtccagctcttcctccaccactggggagaagatcacgaaggtctatgagctggggaatgagccggagaggaagctgtgggtcgaccgttacctaacgttcatggaagagaggggctccccggtgtccagtctgccagcagtgggcaagaagcccctggacctgttccgactgtatgtctgcgtcaaggagattggaggtttggcgcaggttaataaaaacaagaagtggcgtgagctggcaaccaacctgaacgttggcacttccagcagcgcagccagctctctgaaaaagcagtatattcagtacctgttcgcctttgagtgcaaaactgagcgcggggaggagcccccacctgaagtcttcagcaccggggattcgaagaagcagccaaagctccagccgccatctcctgctaactcaggatccttacaaggcccacagactccacagtcaactgggagcaattcgatggcagaggttccaggtgacctgaagccaccaaccccagcctctacccctcatggacagatgactcccatgcaaagcggaagaagcagtacagtcagtgtgcatgacccgttctcagacgtgagtgactcagcgtacccaaaacggaactccatgactccaaacgccccataccagcagggcatgggcatgccagacatgatgggcaggatgccctatgaacccaacaaggaccctttcagtggaatgagaaaagtgcctggaagtagtgagccctttatgacacaaggacaggtgcccaacagcggcatgcaggacatgtacaaccagagcccctcaggggccatgtccaatctgggcatgggacagcggcagcagtttccctatggaaccagttatgaccgaaggcatgaggcttacggacagcagtacccaggccaaggccctcccacaggacagccaccgtatggaggacaccagcctggcctgtacccacagcagccgaattacaaacgtcatatggatggcatgtacgggcctccagccaagcggcacgagggagacatgtacaacatgcagtatggcagccagcagcaggagatgtataaccagtatggaggctcctactctggcccggacagaaggcccatccagggacaatatccctacccctacaacagagaaaggatgcagggcccaggccagatgcagccacacggaatcccacctcagatgatggggggccccatgcagtcatcctccagcgaggggcctcagcagaacatgtgggctacacgcaacgatatgccttatccctaccagagcaggcaaggcccgggcggccctgcacaggcccccccttacccaggcatgaaccgcacagatgatatgatggtacctgagcagaggatcaatcacgagagccagtggccttctcacgtcagccagcgccagccttacatgtcatcttcggcctccatgcagcccatcacgcgcccacctcagtcatcctaccagacgccgccgtcactgccaaaccacatctccagggcacccagccccgcctccttccagcgctccctggagagtcgcatgtctccaagcaagtctcccttcctgcccaccatgaagatgcagaaggtcatgcccacagtccccacatcccaggtcaccgggccccccccacagcctccaccaatcagaagggagattacctttcctcctggctccgtagaagcatcacagccaatcctgaaacaaaggcgaaagattacctcaaaagatattgttactcccgaggcgtggcgtgtgatgatgtcccttaaatcgggtctgttggctgagagcacgtgggctctggacaccatcaatattctcctctatgatgacagcaccgtcgccaccttcaatctttcccagctgtctggattcctggaactattagtagagtactttcgaaaatgcctaattgacattttcggaattcttatggaatatgaagtgggtgaccccagccaaaaggctcttgatcaccgttcagggaagaaagatgacagccagtccctggaagatgattctgggaaggaagacgatgatgctgagtgtcttgtggaagaggaggaggaggaagaggaggaggaggaagacagtgaaaagatagagtcagaggggaagagcagccctgccctagctgctccagatgcctccgtggaccccaaggagacgccaaagcaggccagtaagtttgacaagctgcccataaagattgtcaaaaagaacaagctgtttgtggtggaccggtccgacaagctgggccgagtgcaggagttcagcagcgggctcctccactggcagctgggtggtggcgacactaccgagcacatccagactcacttcgagagcaagatggagatccctcctcgcaggcgtccacctccgcctctaagctccacgggtaagaagaaagagctggaaggcaaaggtgattctgaagagcagccagagaaaagtatcatagccaccatcgatgacgtcttgtctgcccggccaggggctctgcctgaagacaccaacccaggaccccagaccgacagcggcaagtttccctttggaatccagcaggccaaaagccaccggaacatcaggctcctggaagacgagcccaggagccgagacgagacgccgctgtgcaccatcgcgcactggcaggactcactggccaagcgctgcatctgtgtgtcgaacatcgtgcggagcttgtctttcgtgcctggcaacgacgcagagatgtccaaacacccgggcttggtgctgatcctgggaaagctgattctgctgcatcacgagcatccggagagaaagcgggcgccacagacctatgagaaggaggaggacgaggacaagggggtggcctgcagcaaagatgagtggtggtgggactgcctcgaggtcttgcgggataacaccctggtcacgttggcgaacatttccgggcagctagacttgtctgcttacacagagagcatctgcttgccgatcctggacggcttgctacactggatggtgtgcccgtccgcagaggctcaggacccctttcccactgtggggcccaactcagtcctgtcgccgcagagacttgtgctggagaccctgtgtaaactcagtatccaggacaacaacgtggacctgatcttggccacgcctccatttagtcgtcaggagaaattttatgctacattagttaggtacgttggggatcgcaaaaatccagtctgtcgagaaatgtccatggcgcttttatcgaaccttgcccagggggacacactggcggcgagggcaatagctgtgcagaaaggaagcattggtaacttgataagcttcctagaggacggggtgacgatggcgcagtaccagcagagccagcataaccttatgcacatgcagcccccacctctggaaccccctagtgtagacatgatgtgccgggcggccaaagctctgctggccatggccagagtggacgagaaccgctcggagttccttttgcacgagggtcggttgctggatatctcaatatcagctgtcctgaactctctggttgcatctgtcatctgtgatgtactgtttcagattgggcagttatgacatccgtgaaggcacacatgtgtgagtgaacattagagggtcacatataactggctgttttctgttctcgtttatccagtgtaagaagaaggaaaagaaaaatctttgctcctctgccccgtttactatttaccaattgggaattaaatcattaatttgaacagttataaaattaatatttgctgtctgtgtgtataagtacatcctctggcggttttctgtttcttttttttttaaccaaagttgccgtctagtgcattcaaaggtcacaatttttgtttgtttgtttgtttgtttgttttttcataatttttttcatgttgtattgcagtctttgggaagtgaattgactttataaagaaaaacgttttggcaaaaagtgctaagatagaaaaatgtcaccacactgggtcaaaaacgtgaaaggaaaaattgattcttaaattgatttcctatgaattttattcttcacagaatgataaaagctaaactgcaccccgtcacccaaagctctgtgcaatagaaacttctagagatatagtgtaggggctgaaggaggtatggcagcagtagtcagggtcaatgatactgctttctccaccggaaagtggttacgttaggcctcgagcaaaaaacagcgctctcagataggtgcaaaaatccactcctagcagccaacagcaggatcgcttcctcaccacgaccgccatgtctgctgtggctcagcctccacgggacaaagcttcaagatttctttcatcatttttttaaatattttttttactgcctatgggctgtgatgtatatagaagttgtacattaaacataccctcatttttttcttcttttctttttttctttttttctttttctttttttttttttttagtacaaagtttttagtttctttttcatgatgtggtaactacgaagtgatggtagatttaaataattttttatttttattttatatattttttcattaggaccatatctccaaaaaacaagaaaaagaaacaaaaaatacaaaaaataaaaacaaacaaaaaaagagggtaatgtacaagtttctgtatgtataaagtcatgctctgttgggagagcggctgatcccagtttgcttcatgaatcaaagtgtggaaatggttgcatacagattgatttagaaaatggacaccagtacatacaaaaaaagaaaaaagaaagaaaaccaactaaatggaagaaacacaacttcaaagatttttctgtgacaagaatccacatttgtatttcaagataatgtagtttaagaaaagaaaaaaaagaaaaaaaaagaaaaaaacttgatgtaaattcctccttttcctctggcttaatgaatatcatttattcagtataaaatctttatatgtcccacatgttaagaataaatgtacattaaatcttgttacgcactgtgatgggtgttcttgaatgctgttctagtttgcctagcatggttgccatagtaaccaagttatttacaggaaatagggaagatgtaacaactgcttcctggtaatgatgcccaaaggccagaagggactttcagggtttcctacttgagagtgggagcaacaatttgattttctcagattgtttagctaattaggtcttctttgaagcaattaactctggtgacattgagaagtggtaattccctcatggatgggtggtggctgccaacccactgtgacatggggccctgcaagctaactggcctgaaaccacgaccttctgcctctcactactgatttaacccaagtctgcacccgtcatgtttcttctgtgtgcctccaagttactctgcgttagtttgctccagcgtgtataatatttatattgtgcaatgttaaagagaacgtgtcatattgtatgccgtgtgtatagtgccaagtgatgattctgtttcagagcataccttccttcctgcccagtccctggctctctaataccccaccctgatggaaagtgcttcttcctgggtaattgactgttactgtgtaacgctcagtctcattgaaacttacataaccatgctgctggtgccccttcctaccctacctctctcagcactcttcagttgacacttcccacacctgtcactgtggcccaccttgctcacgctgacatctggaagagttagacaggagcacacacttacaacactaggagatgttattctggtgtcacgagaaagaaattggtttttcctgcaaacagtcccatcaccaagcagcccccacatcaggtcagcaaaaagatctgtgttgaatcaaaactccatttataattctactagatgggaatacatctgcttacaaaggacagattttagtgttctgtgatgaaaatatggagagtgcaagagagagttcaatggaatcctaatcttgctcttgcagacaatgaatgaaaggtatagacaggctcagttccctgtcagaagagtggtctcaaagacaagtggctgtatagcagccaggcccagaacagcctcgcagcacacactaacaccaagcgggtgtctgagctctcctaggaagccttgtgcctgccctccctccattcacccagatccgactcctggaagcccacgaaagagtcaccctttgcttcacatttcctgacgataccgagttgctgctctgtcctaaaaatattagttcttttccagggctttcagaaatttgcaggatgcccatactctaaatgtgtaccaaaaagagagagaaataaaggtgcgaagaaagtttagtattttggaatggtgcgataaaatggaatctgttggtttttaatgtaacataagatactattggctggcactggctaaaaaaaatatctaagtgttggagttggatgcacaatcaacttttacttagctattcaaagagtacttatgttttccaagttaaaacagacttgtttttgacaggggccgtgggtggtcttatacaatgccagctcctaactgcagcttctgagaactggatatcgtttgccctgagagctgcccgtctccaactatgtgctgctgctgccctgtgtgctcagcccacaaggatgtggagactggatagacaaccccttgcttcttgctgggttgtgctgagttctttgcagtccagtcaagtgcccagagctaccagcctacgtccctcatgcatccaagagaaatgatcttgactatcatgatcaaaacagctgtagtaatatttctagtaaatatttctgatgactctgtgtaatctcctacaacaggacactattcattaacttgacagagacatgtgggcatgtggtcctgctttagtttaacagacaagtcaaccagttctcattacttaggaagagtgaggctatgtctgttacaatcccaatgtggtgcttgcccttatccaaagacagtccgggggccctgtctgcctgaactatgtctcgctccctcttgggcttcccactgggatgtgaaaagataaccaatggctcccaggttcccagtgccccccaaaccagtaatcaggtctgggactacagaacccgcaaaatcatacacaggctgtttcaaagccagtactctctttatactcctgcttcctccagcccccatttcacaccccacccaaatcacaaggtcctctgaagtctcagaactccaaattaacgttgggatttacgatgtgaatgctgaggagaaaattgggagttggtgggagatcaccaaattgtcaaaactatgaaactcatctgtcttcccaaatctgacctcagggacttggggggttcactctggcttctgccacagtattttctggggaaccaaaggcctcgggaatagagaaacaggttgccggatatcctggaagtctaagccatactgaccagtttgtcttgagtgttttctttgtgagcctggaactgtccccggacccctttcttttaaacatggttcaggactttaaaaaaaagcactgtattttttttatgtaagccaagatgccctccctagcagagatagcgttgaactgtctctagttctgtagcctgagagacttaaatcgtttaacttcagtgtctttgtccactctgttgaactgctaaggattctattgaatgtgttctttgcggctttggaggagttgctgggtgtgtaagtcctgcatccctttgcctggtatgtgtatattattcctttgcctggctgtgtatcgttcttcagtgtaagtacacccacactctgtattcctttgcctgctccccgcccccccacacacacacatcctgcatagttttaaaataaggcctgagagactgtttctatttcctgtcatagctggtgacttttaacagttgaggcgaatggcctgtcacttgcctgggttcccgtcaggggtgatccatggaactcctcagtggaacagaatttaggacagaagatcccaccttccttccaggcctggggagaatcagactgtgagataaaccatgatgctgcccaatcccactgccccaccttgcttttaaaataaagtgcctcctaacgtc

SEQ ID NO: 42 - protein, 2244 aa, Mus musculus
METGLLPNHKLKAVGEAPAAPPHQQHHHHHAHHHHHHHAHHLHHLHHHHALQQQLNQFQQPQPPQPQQQQPPPPPQQQHPTANNSLGGAGGGAPQPGPDMEQPQHGGAKDSVAGNQADPQGQPLLSKPGDEDDAPPKMGEPAGSRYEHPGLGAQQQPAPVAVPGGGGGPAAVSEFNNYYGSAAPASGGPGGRAGPCFDQHGGQQSPGMGMMHSASAAAGAPSSMDPLQNSHEGYPNSQYNHYPGYSRPGAGGGGGGGGGGGGSGGGGGGGGAGGAGGAAAAAAGAGAVAAAAAAAAAAAAAAGGGGGGGYGSSSSGYGVLSSPRQQGGGMMMGPGGGGAASLSKAAAGAAAAAGGFQRFAGQNQHPSGATPTLNQLLTSPSPMMRSYGGSYPDYSSSSAPPPPSQPQSQAAAGAAAGGQQAAAGMGLGKDLGAQYAAASPAWAAAQQRSHPAMSPGTPGPTMGRSQGSPMDPMVMKRPQLYGMGTHPHSQPQQSSPYPGGSYGPPGAQRYPLGMQGRAPGALGGLQYPQQQMPPQYGQQAVSGYCQQGQQPYYNQQPQPSHLPPQAQYLQPAAAQSQQRYQPQQDMSQEGYGTRSQPPLAPGKSNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMTGTQRNPQMSQYGPQQTGPSMSPHPSPGGQMHPGISNFQQSNSSGTYGPQMSQYGPQGNYSRTPTYSGVPSASYSGPGPGMGINANNQMHGQGPAQPCGAMPLGRMPSAGMQNRPFPGTMSSVTPSSPGMSQQGGPGMGPPMPTVNRKAQEAAAAVMQAAANSAQSRQGSFPGMNQSGLVASSSPYSQSMNNNSSLMSTQAQPYSMTPTMVNSSTASMGLADMMSPSESKLSVPLKADGKEEGVSQPESKSKDSYGSQGISQPPTPGNLPVPSPMSPSSASISSFHGDESDSISSPGWPKTPSSPKSSSSSTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKTERGEEPPPEVFSTGDSKKQPKLQPPSPANSGSLQGPQTPQSTGSNSMAEVPGDLKPPTPASTPHGQMTPMQSGRSSTVSVHDPFSDVSDSAYPKRNSMTPNAPYQQGMGMPDMMGRMPYEPNKDPFSGMRKVPGSSEPFMTQGQVPNSGMQDMYNQSPSGAMSNLGMGQRQQFPYGTSYDRRHEAYGQQYPGQGPPTGQPPYGGHQPGLYPQQPNYKRHMDGMYGPPAKRHEGDMYNMQYGSQQQEMYNQYGGSYSGPDRRPIQGQYPYPYNRERMQGPGQMQPHGIPPQMMGGPMQSSSSEGPQQNMWATRNDMPYPYQSRQGPGGPAQAPPYPGMNRTDDMMVPEQRINHESQWPSHVSQRQPYMSSSASMQPITRPPQSSYQTPPSLPNHISRAPSPASFQRSLESRMSPSKSPFLPTMKMQKVMPTVPTSQVTGPPPQPPPIRREITFPPGSVEASQPILKQRRKITSKDIVTPEAWRVMMSLKSGLLAESTWALDTINILLYDDSTVATFNLSQLSGFLELLVEYFRKCLIDIFGILMEYEVGDPSQKALDHRSGKKDDSQSLEDDSGKEDDDAECLVEEEEEEEEEEEDSEKIESEGKSSPALAAPDASVDPKETPKQASKFDKLPIKIVKKNKLFVVDRSDKLGRVQEFSSGLLHWQLGGGDTTEHIQTHFESKMEIPPRRRPPPPLSSTGKKKELEGKGDSEEQPEKSIIATIDDVLSARPGALPEDTNPGPQTDSGKFPFGIQQAKSHRNIRLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDTLAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 43 - DNA, 5024 bp, Homo sapiens
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 44 - protein, 1406 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 45 - DNA, 4688 bp, Homo sapiens
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 46 - protein, 1294 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 47 - DNA, 5082 bp, Homo sapiens
atgtgcgcgcacgccgctttacgcatgctccttaagttccccgtactccctcggagaccctagctacacgccgaatccgttactccgggttttcgcagtggctcggtggcctaccccgatcgaaacctagtctggaactgaacctacaatatctctgagggaggacacatctatgactagcagtggcatgtgctcaggaaagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagaggcagaccaatgtgggaagggcactcactgagttgggatccagaggacctaagtaccaagtttcactgtttcgcttctgtgtaggatcttgggcaactggaaacaccttctttttatcatctataaaaccaggatccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 48 - protein, 1382 aa, Homo sapiens
MKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKRQTNVGRALTELGSRGPKYQVSLFRFCVGSWATGNTFFLSSIKPGSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 49 - DNA, 3416 bp, Homo sapiens
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 50 - protein, 870 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLRGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 51 - DNA, 4702 bp, Mus musculus
gaagtgctttctgattctctgtctgtggaggagccctgggaggggtgggacagagatggcatcctggctctctgaggcacctgctcttctctgaaccacacaggagtcaagagccaaacagggatagcttcagcagcacttcagagggtgttctctaagtaagaacatgaagctcaagagaactgcctaccttctcttcctgtacctcagctcctcactgctcatctgcataaagaattcattttgcaataaaaacaataccaggtgcctttcaggtccttgccaaaacaattctacgtgcaagcattttccacaagacaacaattgttgcttagacacagccaataatttggacaaagactgtgaagatctgaaagacccttgcttctcgagtccctgccaaggaattgccacttgtgtgaaaatcccaggggaagggaacttcctgtgtcagtgtcctcctgggtacagcgggctgaactgtgaaactgccaccaattcctgtggagggaacctctgccaacatggaggcacctgccgtaaagaccctgagcaccctgtctgtatctgccctcctggatatgctggaaggttctgtgagactgatcacaatgagtgtgcttctagcccttgccacaatggggctatgtgccaggatggaatcaatggctactcctgcttctgtgtgcctggataccaaggcaggcattgtgacttggaagtggatgaatgtgtttctgatccctgcaagaatgaggctgtgtgcctcaatgagataggaagatacacttgtgtctgccctcaagagttttctggcgtgaactgtgagttggaaattgatgaatgcagatcccagccttgtctccacggtgccacatgtcaggacgctccagggggctactcctgtgactgtgcacctggattccttggagagcactgtgaactcagcgttaatgaatgtgaaagtcagccgtgtctccatggaggtctatgtgtggatggaagaaacagttaccactgtgactgcacaggtagtggattcacagggatgcactgtgagtccttgattcctctttgttggtcaaagccttgtcacaacgacgcgacatgtgaagatactgttgacagctatatttgtcactgccggcctggatacacaggtgccctgtgtgagacagacataaatgaatgcagtagcaacccctgccaattttggggggaatgtgtcgagctgtcctcagagggtctatatggaaacactgctggcctgccttcctccttcagctatgttggagcctcgggctatgtgtgtatctgtcagcctggattcacaggaattcactgtgaagaagacgttgatgaatgtttactgcacccttgcctaaatggtggtacttgtgagaacctgcctgggaattatgcctgtcactgtccctttgatgacacttctaggacattttatggaggagaaaactgctcagaaattctcctgggctgcactcatcaccagtgtctgaacaatggaaaatgtatccctcatttccaaaatggccagcatggattcacttgccagtgtctttctggctatgcggggcccctgtgtgaaactgtcaccacactttcatttgggagcaatggcttcctatgggtcacaagtggctcccatacaggcatagggccagaatgtaacatatccttgaggtttcacactgttcaaccaaacgcacttctcctcatccgaggcaacaaggacgtgtctatgaagctggagttgctgaatggttgtgttcacttatcaattgaagtctggaatcagttaaaggtgctcctgtctatttctcacaacaccagtgatggagaatggcatttcgtggaggtaacaatcgcagaaactctaacccttgccctagttggcggctcctgcaaggagaagtgcaccaccaagtcttctgttccagttgagaatcatcaatcaatatgtgctttgcaggactcttttttgggtggcttaccaatggggacagccaacaacagtgtgtctgtgcttaacatctataatgtgccgtccacaccttcctttgtaggctgtctccaagacattagatttgatttgaatcacattactctggagaacgtttcatctggcctgtcatcaaatgttaaagcaggctgcctgggaaaggactggtgtgaaagtcaaccctgtcaaaacagaggacgctgcatcaacttgtggcagggttatcagtgtgaatgtgacaggccctatacaggctccaactgcctgaaagagtatgtagcgggaagatttggccaagatgactccacaggatatgcggcctttagtgttaatgataattatggacagaacttcagtctttcaatgtttgtccgaacacgtcaacccctgggcttacttctggctttggaaaatagtacttaccagtatgtcagtgtctggctagagcacggcagcctagcactgcagactccaggctctcccaagttcatggtaaacttttttctcagtgatggaaatgttcacttaatatctttgagaatcaaaccaaatgaaattgaactgtatcagtcttcacaaaacctaggattcatttctgttcctacatggacaattcgaagaggagacgtcatcttcattggtggcttacctgacagagagaagactgaagtttatggtggcttcttcaaaggctgtgttcaagatgtcagattaaacagccagactctggaattctttcccaattcaacaaacaatgcatacgatgacccaattcttgtcaatgtgactcaaggctgtcccggagacaacacatgtaagtccaacccctgtcataatggaggtgtctgccactccctgtgggatgacttctcctgctcctgccctacaaacacagcggggagagcctgcgagcaagttcagtggtgtcaactcagcccatgtcctcccactgcagagtgccagctgctccctcaagggtttgaatgtatcgcaaacgctgttttcagcggattaagcagagaaatactcttcagaagcaatgggaacattaccagagaactcaccaatatcacatttgctttcagaacacatgatacaaatgtgatgatattgcatgcagaaaaagaaccagagtttcttaatattagcattcaagatgccagattattctttcaattgcgaagtggcaacagcttttatacgctgcacctgatgggttcccaattggtgaatgatggcacatggcaccaagtgactttctccatgatagacccagtggcccagacctcccggtggcaaatggaggtgaacgaccagacaccctttgtgataagtgaagttgctactggaagcctgaactttttgaaggacaatacagacatctatgtgggtgaccaatctgttgacaatccgaaaggcctgcagggctgtctgagcacaatagagattggaggcatatatctttcttactttgaaaatctacatggtttccctggtaagcctcaggaagagcaatttctcaaagtttctacaaatatggtacttactggctgtttgccatcaaatgcctgccactccagcccctgtttgcatggaggaaactgtgaagacagctacagttcttatcggtgtgcctgtctctcgggatggtcagggacacactgtgaaatcaacattgatgagtgcttttctagcccctgtatccatggcaactgctctgatggagttgcagcctaccactgcaggtgtgagcctggatacaccggtgtgaactgtgaggtggatgtagacaattgcaagagtcatcagtgtgcaaatggggccacctgtgttcctgaagctcatggctactcttgtctctgctttggaaattttaccgggagattttgcagacacagcagattaccctcaacagtctgtgggaatgagaagagaaacttcacttgctacaatggaggcagctgctccatgttccaggaggactggcaatgtatgtgctggccaggtttcactggagagtggtgtgaagaggacatcaacgagtgtgcctccgatccctgcatcaatggaggactgtgcagggacttggtcaacaggttcctatgcatctgtgatgtggccttcgctggcgagcgctgtgagctggacctggctgatgacaggctcctgggcattttcaccgctgttggctccggaactttggccctgttcttcatcctcttgcttgctggggttgcttctcttattgcctccaacaaaagggcgactcaaggaacctacagccccagcggtcaggagaaggctggccctcgagtggaaatgtggatcaggatgccgcccccggcactggaaaggctcatctaggagactgctgctcttctcaggacagagaagaacatgatgagtaccgggtcgtgcctgagtgaagatggctttacatcactagagatacatacagctgggactgtgggaaggaccttcctgtggagtcactgagtagttatgtcatccattcacagaagagtgtccctgtgtttgcctgtcagcctcagaattagcaaaacatctagcagacagagaacacagtatttcagaagaactccagaggctgccccttaaactctttactggttgatccacataaaatgcttagtagccaagtgccattaattatacagagcc

SEQ ID NO: 52 - protein, 1405 aa, Mus musculus
MKLKRTAYLLFLYLSSSLLICIKNSFCNKNNTRCLSGPCQNNSTCKHFPQDNNCCLDTANNLDKDCEDLKDPCFSSPCQGIATCVKIPGEGNFLCQCPPGYSGLNCETATNSCGGNLCQHGGTCRKDPEHPVCICPPGYAGRFCETDHNECASSPCHNGAMCQDGINGYSCFCVPGYQGRHCDLEVDECVSDPCKNEAVCLNEIGRYTCVCPQEFSGVNCELEIDECRSQPCLHGATCQDAPGGYSCDCAPGFLGEHCELSVNECESQPCLHGGLCVDGRNSYHCDCTGSGFTGMHCESLIPLCWSKPCHNDATCEDTVDSYICHCRPGYTGALCETDINECSSNPCQFWGECVELSSEGLYGNTAGLPSSFSYVGASGYVCICQPGFTGIHCEEDVDECLLHPCLNGGTCENLPGNYACHCPFDDTSRTFYGGENCSEILLGCTHHQCLNNGKCIPHFQNGQHGFTCQCLSGYAGPLCETVTTLSFGSNGFLWVTSGSHTGIGPECNISLRFHTVQPNALLLIRGNKDVSMKLELLNGCVHLSIEVWNQLKVLLSISHNTSDGEWHFVEVTIAETLTLALVGGSCKEKCTTKSSVPVENHQSICALQDSFLGGLPMGTANNSVSVLNIYNVPSTPSFVGCLQDIRFDLNHITLENVSSGLSSNVKAGCLGKDWCESQPCQNRGRCINLWQGYQCECDRPYTGSNCLKEYVAGRFGQDDSTGYAAFSVNDNYGQNFSLSMFVRTRQPLGLLLALENSTYQYVSVWLEHGSLALQTPGSPKFMVNFFLSDGNVHLISLRIKPNEIELYQSSQNLGFISVPTWTIRRGDVIFIGGLPDREKTEVYGGFFKGCVQDVRLNSQTLEFFPNSTNNAYDDPILVNVTQGCPGDNTCKSNPCHNGGVCHSLWDDFSCSCPTNTAGRACEQVQWCQLSPCPPTAECQLLPQGFECIANAVFSGLSREILFRSNGNITRELTNITFAFRTHDTNVMILHAEKEPEFLNISIQDARLFFQLRSGNSFYTLHLMGSQLVNDGTWHQVTFSMIDPVAQTSRWQMEVNDQTPFVISEVATGSLNFLKDNTDIYVGDQSVDNPKGLQGCLSTIEIGGIYLSYFENLHGFPGKPQEEQFLKVSTNMVLTGCLPSNACHSSPCLHGGNCEDSYSSYRCACLSGWSGTHCEINIDECFSSPCIHGNCSDGVAAYHCRCEPGYTGVNCEVDVDNCKSHQCANGATCVPEAHGYSCLCFGNFTGRFCRHSRLPSTVCGNEKRNFTCYNGGSCSMFQEDWQCMCWPGFTGEWCEEDINECASDPCINGGLCRDLVNRFLCICDVAFAGERCELDLADDRLLGIFTAVGSGTLALFFILLLAGVASLIASNKRATQGTYSPSGQEKAGPRVEMWIRMPPPALERLI

SEQ ID NO: 53 - DNA, 5589 bp, Homo sapiens
ggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 54 - protein, 1679 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKKITGKDIHDTASSVARGLQFQRGLQFCTRASKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 55 - DNA, 5779 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 56 - protein, 1647 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 57 - DNA, 5703 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 58 - DNA, 5329 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 59 - protein, 1618 aa, Homo sapiens
SMSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 60 - DNA, 5326 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 61 - protein, 1616 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 62 - DNA, 5320 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 63 - protein, 1614 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 64 - DNA, 5317 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 65 - protein, 1613 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 66 - DNA, 6376 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaagaccctgaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 67 - protein, 1617 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 68 - DNA, 6367 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 69 - protein, 1614 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 70 - DNA, 6364 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 71 - protein, 1613 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 72 - DNA, 5892 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 73 - protein, 1590 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 74 - DNA, 5838 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 75 - protein, 1572 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 76 - DNA, 5879 bp, Homo sapiens
tcagaagaaagccccgagatcacagagacccggcgagatcacagagacccggcctgaaggaacgtggaaagaccaatgtacctgttttgaccggttgcctggagcaagaagttccagttggggagaattttcagaagataaagtcggagattgtggaaagacttgacttgcagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 77 - DNA, 5664 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 78 - protein, 1514 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 79 - DNA, 1846 bp, Homo sapiens
cttggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 80 - protein, 248 aa, Homo sapiens
MWLAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 81 - DNA, 1833 bp, Homo sapiens
attcacttcattaaatctagaggcagttgagcatgggagccgtctgtatgttgaattagggctcgcactcttgcgcaacacgtcaccagtcggaaactggggctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 82 - protein, 276 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 83 - DNA, 2254 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 84 - protein, 278 aa, Homo sapiens
MLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85 - DNA, 5831 bp, Mus musculus
ctcgctccctctgtttctgtactctgggtgactcagagagggaagattcagccagcacactgctcgcgagcaagtgtcactctgctaactggcagagccaggagacctagatgtccacacccacagacccagcagcaatgccccatcctgggccctccccggggcctggaccctctcctggaccaattctggggcctagtccaggaccaggaccatccccaggttctgtgcacagcatgatgggtcctagtcccggacctcccagcgtctcacatcctctgtcaacgatgggctctgcagacttcccacaggaaggcatgcaccaattacataagcccatggatgggatacatgacaaagggattgtagaagatgtccactgtggatccatgaagggcaccagcatgcgccccccacacccaggaatgggccctccacagagccccatggaccagcacagccaaggttatatgtcaccacatccgtctcctctgggagccccggagcacgtctctagccctatatctggaggaggcccaaccccaccccagatgccaccgagccagccaggggcactcatcccaggagatccgcaggccatgaaccagcctaacagaggtccctcgcctttcagtcctgtgcagctgcatcagcttcgagctcagattttagcttacaaaatgttggccaggggccagcctctccctgaaactctgcagctggcagtccagggaaaaaggaccttgcctggcatgcagcagcagcagcagcaacaacaacaacagcagcagcagcagcagcagcagcagcagcaacagcagcaacaacagcagccccagcagcctcagcagcaggctcaggcacagccccagcagcagcagcaacagcagcagcagccagctcttgttagctataatcgaccatctggccccgggcaggagctgctactgagtggccagagcgctccgcagaagctgtcagcaccagcaccaagcggccgaccttcaccggcaccccaggccgccgtccagcccacggccacagcggtgcccgggccctccgtgcagcagcccgccccagggcagccgtctccggtcctacagctgcaacagaagcagagccgcatcagccccatccagaaaccgcaaggcctggacccggtggagatcctgcaggaacgagagtacagacttcaagctcgcatcgctcataggatacaagaactggaaagtctgcctggttccttgccaccagatttacgcaccaaagcaaccgtggaactgaaagcacttcgcttactcaacttccaacgtcagctgagacaggaggtggtggcctgcatgcggagggacaccaccctggagacggccctcaactccaaagcatataagcggagcaagcgccagaccctgcgtgaggcacgcatgacagagaaactggagaagcagcagaagatagaacaggagaggaaacgccggcagaaacaccaggaatacctgaacagtattttgcaacatgcaaaagattttaaggaatatcaccggtctgtggccgggaagatccagaagctctccaaagcagtggcgacttggcatgctaacacagaaagggagcagaagaaggagacggagcggatcgagaaggagagaatgcggaggctgatggccgaagatgaagagggctacaggaagcttattgaccaaaagaaagacagacgtctcgcctacctattgcagcagaccgatgagtatgtcgccaatctgaccaacctggtgtgggagcacaagcaggcccaagcagccaaagagaagaagaagaggaggaggaggaagaagaaggctgaagagaatgcagagggaggggaacctgccctgggaccagatggagagccaatagatgaaagcagccagatgagtgacctgcctgtcaaagtgacacacacagaaactggcaaggtcctctttggaccagaagcacccaaagcaagtcagctggatgcctggctggagatgaatcctggttacgaagttgcacccagatctgacagtgaagagagtgaatcggactacgaggaggaggatgaagaagaagagtccagtaggcaggaaaccgaggagaagatactgctggatcccaacagtgaagaagtttccgaaaaggatgccaagcagatcattgagactgcgaagcaggacgtggacgacgaatacagcatgcagtacagtgccagaggctctcagtcctactacacggtggctcacgctatctctgagagggtggagaagcagtctgccctcctcattaacggcaccctaaagcattaccagctccagggcctggaatggatggtttccctgtataataacaatctgaacggaatcttagctgatgaaatggggctaggcaagaccatccagaccattgcactcatcacgtatctgatggagcacaaaaggctcaatggtccctacctcatcatcgtccccctctcgactctgtctaactggacatatgaatttgacaaatgggctccttctgtggtgaaaatttcttacaagggtacccctgccatgcgacgctccctcgttccccagctacggagtggcaaattcaatgtcctcctgactacttacgagtacattataaaagacaagcacattcttgcaaagattcggtggaagtacatgatcgtggacgaaggccaccggatgaagaatcaccactgcaagctaacccaggtcctgaacacacactatgtggcccccaggcggatccttctgactgggaccccactgcagaataagcttccggaactctgggccctcctcaacttcctcctccctacaatcttcaagagttgcagcacatttgagcagtggtttaatgctccatttgccatgaccggtgaaagggtggacctgaacgaagaagaaacgattttgatcatcaggcgtctacacaaggtgctgagaccctttttactgaggaggctgaagaaagaggttgagtctcagcttccggaaaaggttgagtatgtgatcaagtgtgacatgtcagctctgcagaagattctgtaccgtcacatgcaagccaaggggatcctcctcacggacgggtctgagaaagataagaaggggaaaggaggtgccaagacacttatgaacaccatcatgcagctgagaaaaatatgcaaccacccatatatgtttcagcacattgaggaatcctttgctgaacacctgggctattcgaatggggtcatcaatggggctgagctgtatcgggcctcgggaaagtttgagctgcttgatcgtattctgcccaaattgagagcgactaaccaccgcgtgctgcttttctgccagatgacgtcactcatgaccattatggaggattactttgcttttcggaacttcctgtacctgcgccttgacggcaccaccaagtctgaagatcgtgctgctttgctaaagaaattcaatgaacctgggtcccagtatttcattttcttgctgagcacaagagcagggggcctgggcttaaatcttcaggcggcagacacggtggtcatatttgacagcgactggaatcctcaccaggatctgcaggcccaagaccgagctcaccgcattggccaacaaaacgaggtccgggtgctgaggctttgcaccgtcaacagtgtggaggaaaagattctcgcggctgccaagtacaagctgaacgtggatcagaaggttatccaagcaggcatgtttgaccagaagtcatccagccacgagcggagggccttcctgcaggccattctggagcacgaggaggagaatgaggaagaagatgaggtaccagacgacgagaccctgaaccagatgattgctcgccgggaggaagaatttgatctttttatgcgcatggacatggaccggcggagggaggatgcccggaacccgaagcgcaaaccccgcttgatggaggaagatgagctgccctcctggattatcaaggatgacgccgaagtggaaaggctcacctgtgaagaagaggaggagaagatatttgggaggggctctcgccagcgccgggatgtggactacagtgatgccctcaccgagaagcaatggctcagggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaaaaaaaaaaaaaaaaaa

SEQ ID NO: 86 - protein, 1583 aa, Mus musculus
MSTPTDPAAMPHPGPSPGPGPSPGPILGPSPGPGPSPGSVHSMMGPSPGPPSVSHPLSTMGSADFPQEGMHQLHKPMDGIHDKGIVEDVHCGSMKGTSMRPPHPGMGPPQSPMDQHSQGYMSPHPSPLGAPEHVSSPISGGGPTPPQMPPSQPGALIPGDPQAMNQPNRGPSPFSPVQLHQLRAQILAYKMLARGQPLPETLQLAVQGKRTLPGMQQQQQQQQQQQQQQQQQQQQQQQQQQPQQPQQQAQAQPQQQQQQQQQPALVSYNRPSGPGQELLLSGQSAPQKLSAPAPSGRPSPAPQAAVQPTATAVPGPSVQQPAPGQPSPVLQLQQKQSRISPIQKPQGLDPVEILQEREYRLQARIAHRIQELESLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGEPALGPDGEPIDESSQMSDLPVKVTHTETGKVLFGPEAPKASQLDAWLEMNPGYEVAPRSDSEESESDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 87 - DNA, 1964 bp, Mus musculus
ttcacttcattaaatctagaggcggttcagcatgggagccgtctgtatgttgaattagggctcgctctcttgcgcaacacgtcaccagtcggaaactgggggtttgcttctgtgatttatttcattattgtgctggtaaaagctgatgaagagactagcagctcgctgctttgccggcttgttaattttatccccactaactgtgatttccgatagccggcctgctgatagtggtaagtgcggctggctctggtttaaagcaagcgtttgcaggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaa

SEQ ID NO: 88 - protein, 236 aa, Mus musculus
MEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 89 - DNA, 1979 bp, Mus musculus
acacacacacacacacacacacgcaggctgaagtatgcttaactcttttaacttggctggggctttttagcaccatatgggttctttcgtgacgtccggacccgaaagagtgcagtgtgcctttaaggaaagaggtacctcaccaaacttccctgtagttgtgcctcaccatttagctgatgaagagactagcagctcgctgctttgccggcttgttaattttatccccactaactgtgatttccgatagccggcctgctgatagtggtaaggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaaaaaaaaaaaaaaaaaa

SEQ ID NO: 90 - protein, 276 aa, Mus musculus
MKRLAARCFAGLLILSPLTVISDSRPADSGKAIEDGNLEEMEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 91 - DNA, 6369 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctaaaaaaaaaaaaaaaaa

SEQ ID NO: 92 - protein, 1210 aa, Homo sapiens [sequence omitted]

SEQ ID NO: 93 - DNA, 2239 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 94 - protein, 628 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 95 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 96 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 97 - DNA, 2865 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 98 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 99 - DNA, 3859 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagaaaaaaaaaaaaaaaa

SEQ ID NO: 100 - protein, 1091 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 101 - DNA, 3994 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagaaaaaaaaaaaaaaaa

SEQ ID NO: 102 - protein, 1136 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 103 - DNA, 6234 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctaaaaaaaaaaaaaaaaa

SEQ ID NO: 104 - protein, 1165 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 105 - DNA, 6166 bp, Homo sapiens
ccttttgaatgagctctaaaacagttctccactggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctaaaaaaaaaaaaaaaaa

SEQ ID NO: 106 - protein, 1157 aa, Homo sapiens
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 107 - DNA, 5552 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagcta

SEQ ID NO: 108 - protein, 943 aa, Homo sapiens
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 109 - DNA, 5983 bp, Mus musculus
ctcccccagtcccgacccgagctaactagacgtctgggcagccccagcgcaacgcgcagcagcctccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggccaaagataccatctattgccactgggattgtgggtggcctcctcttcatagtggtggtggcccttgggattggcctattcatgcgaagacgtcacattgttcgaaagcgtacactacgccgcctgcttcaagagagagagctcgtggaacctctcacacccagcggagaagctccaaaccaagcccacttgaggatattaaaggaaacagaattcaaaaagatcaaagttctgggttcgggagcatttggcacagtgtataagggtctctggatcccagaaggtgagaaagtaaaaatcccggtggccatcaaggagttaagagaagccacatctccaaaagccaacaaagaaatccttgacgaagcctatgtgatggctagtgtggacaaccctcatgtatgccgcctcctgggcatctgtctgacctccactgtccagctcattacacagctcatgccctacggttgcctcctggactacgtccgagaacacaaggacaacattggctcccagtacctcctcaactggtgtgtgcagattgcaaagggcatgaactacctggaagatcggcgtttggtgcaccgtgacttggcagccaggaatgtactggtgaagacaccacagcatgtcaagatcacagattttgggctggccaaactgcttggtgctgaagagaaagaatatcatgccgaggggggcaaagtgcctatcaagtggatggctttggaatcaattttacaccgaatttatacacaccaaagtgatgtctggagctatggtgtcactgtgtgggaactgatgacctttgggtccaagccttatgatggaatcccagcaagtgacatctcatccatcctagagaaaggagagcgccttccacagccacctatctgcaccatcgatgtctacatgatcatggtcaagtgctggatgatagatgctgatagccgcccaaagttccgagagttgattcttgaattctccaaaatggcccgagacccacagcgctaccttgttatccagggggatgaaagaatgcatttgccaagccctacagactccaacttttaccgagccctgatggatgaagaggacatggaggatgtagttgatgctgatgagtatcttatcccacagcaaggcttcttcaacagcccgtccacgtcgaggactcccctcttgagttctctgagtgcaactagcaacaattccactgtggcttgcattaatagaaatgggagctgccgtgtcaaagaagacgccttcttgcagcggtacagctccgaccccacaggtgctgtaacagaggacaacatagatgacgcattcctccctgtacctgaatatgtaaaccaatctgttcccaagaggccagcaggctctgtgcagaaccctgtctatcacaatcagcccctgcatccagctcctggaagagacctgcattatcaaaatccccacagcaatgcagtgggcaaccctgagtatctcaacactgcccagcctacctgtctcagtagtgggtttaacagccctgcactctggatccagaaaggcagtcaccaaatgagcctagacaaccctgactaccagcaggacttcttccccaaggaaaccaagccaaatggcatatttaagggccccacagctgaaaatgcagagtacctacgggtggcacctccaagcagtgagtttattggagcatgacaagaaggggcatcataccagctataaaatgtctggactttctagaatcccaggaccaactatggcagcacctccacttctggtagccatgcccacgctgtgtcaaatgtcactcagactggctttaaagcataactctgatgggctttgtcactgagccaagaagtgggcctctctcctgatgcactttgggaagttgaaggtacatcaattgatcttcgaactgtgaagattccacaaaaaaggtatccatcgagaacattgtccattggaacagaagtttgcctcatggtgaggtacatatgggaaaaaaacagacatatggagcttatatttagggaactttgggattcttgtctttattgatttgattgatgcactcttgtagtctggtacacagagttgcctggagccaactgaccagacagttggttccaccagctctgcatcaagacacttccgtggcaagacaactaaatgtataagaagtccatggatgccctgagcaggccacacttgtacagcattaaaccatggcagatacaataggataagccactttgttacttactggggctgggagaagaggaatgacggggtagaattttccctcagacgtactttttatataaatatgtccctggcacctaacacgcgctagtttaccagtgttttctattagacttccttctatgttttctgtttcattgttttgagttgtaaatatgtgttcctgtcttcatttcatgaagtaaacaaacaaacaaaaaacccagtattaagtattatcaaagaacaaccatgattccacattcgaacccattcaaaccatcagtattgtgaccaaaagcctttaactaagaaggagtaaccatgcaaaaatccatagaggaatttaacccaaaattttagtctcagcattgtgtctgctgaggtgtgtatatgagactacgaaagtgaactactcttcaaatccactttgccttcactcctctataccctaaatctagtgtaaaccacacatggaggataacttttttttttaattttaaaagtgtttattagatatgtttttcttcctggtaaactgcagccaaacatcagttaagagccatttttgataaacactatcacaatgatctcgggatccatcctttccgatttaccaagtgatggatagacgtgaactcataaacactacccataagacaaaacaatgagtgccagacaagacatcagccaggcaccagagcacagagcaggactgggcaatctgttggagatatctagaaagttcacaaaggaaacaagattgtccactaccttgtgagatctagcagtcataaataccagggaaatggaaagtgtgtttccttacagcaccaggtcttcgatcttcctaatgctgtgaccctttaatacagtttgccatgttgtggtgacccccaaccataaaattatttttgttgctacttcataactgtaaatttgctactcttacagaccacaatgtaaatatctgatatgctatctgatatgcaggctatctgacagaggtcgcaacccgcaggttgagagccactgccttcaaggctttaatcaagagagtagtgagctgagggctttactggtaagtcaggggcaagtccaactcaatcatcctcacatactggctgctccctcaggcctgagaatgaggcttgcagcatcctctggtttcctaaccgttatccatccctgactctcatctctgaaaatagatgtcatccatgaaattaaggagtgagaatattaagcagcatttatagagctcaaaattccatgtcatcaccaggaagtgccatgttgatcacagagaacacagaggagacatatagacagggttttgctcaaaattgggatatagaatgagcctgtcaggtacctatcaggagcggtaatccgtgagagagaaccgttgcaagccactctaactgtagcaatgaaaccctagtatttttgtactttgaaatactttcttataacaaaataaagtagcaaaaaaactgttcaaaaaaaaaaaaaaaaaaa

SEQ ID NO: 110 - protein, 1210 aa, Mus musculus
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYALAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVGLNITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNILEGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGPKIPSIATGIVGGLLFIVVVALGIGLFMRRRHIVRKRTLRRLLQERELVEPLTPSGEAPNQAHLRILKETEFKKIKVLGSGAFGTVYKGLWIPEGEKVKIPVAIKELREATSPKANKEILDEAYVMASVDNPHVCRLLGICLTSTVQLITQLMPYGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASDISSILEKGERLPQPPICTIDVYMIMVKCWMIDADSRPKFRELILEFSKMARDPQRYLVIQGDERMHLPSPTDSNFYRALMDEEDMEDVVDADEYLIPQQGFFNSPSTSRTPLLSSLSATSNNSTVACINRNGSCRVKEDAFLQRYSSDPTGAVTEDNIDDAFLPVPEYVNQSVPKRPAGSVQNPVYHNQPLHPAPGRDLHYQNPHSNAVGNPEYLNTAQPTCLSSGFNSPALWIQKGSHQMSLDNPDYQQDFFPKETKPNGIFKGPTAENAEYLRVAPPSSEFIGA

SEQ ID NO: 111 - DNA, 2678 bp, Mus musculus
ctcccccagtcccgacccgagctaactagacgtctgggcagccccagcgcaacgcgcagcagcctccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggtacgttcaatggcagtggatcttaaagaccttttggatctaagaccagaagccatctctgactcccctctcaccttccagtttcttccaaatcctctgggccagccagaggtctcagattctgccctcttgccctgtgcccaccttgttgaccactggacagcatatgtgatggctactgctagtgccagcttcacaagaggttaacactacggactagccattcttcctatgtatctgtttctgcaaatacagccgctttacttaagtctcagcacttcttagtctcctcttttcctctcagtagcccaaggggtcatgtcacaaacatggtgtgaagggctactttgtcaaatgaaaaggtctatcttggggggcatttttttcttttctttttttcttgaaacacattgcccagcaaagccaataaatttctctcatcattttgtttctgataaattcttactattgat

SEQ ID NO: 112 - protein, 655 aa, Mus musculus
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYALAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVGLNITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNILEGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGYVQWQWILKTFWI

What is claimed is:

1. A method of treating a cancer in a subject likely to be responsive to an immune checkpoint therapy, wherein the immune checkpoint therapy comprises at least one antibody selected from the group consisting of anti-PD-1 antibodies, anti-CTLA-4 antibodies, and combinations thereof, the method comprising
   i) selecting the subject, the subject having been identified according to:
      a) obtaining or providing a subject sample from a patient having cancer;
      b) measuring the amount or activity of ARID2 in the subject sample; and
      c) comparing the amount or activity of ARID2 in a control sample,
      wherein the absence of or a significantly decreased amount or activity of ARID2 in the subject sample and/or the presence of or a significantly increased amount or activity of ARID2 having a loss of function mutation resulting from a missesnse mutation, nonsense mutation, splice site mutation, or frame shift deletion mutation in the subject sample, relative to the control sample identified the cancer as being more likely to be responsive to the immune checkpoint therapy; and
   ii) administering the immune checkpoint therapy to the selected subject.

2. The method of claim 1, wherein the control sample is determined from a cancerous or non-cancerous sample from either the patient or a member of the same species to which the patient belongs, optionally wherein the control sample is a cancerous or non-cancerous sample from the patient obtained from an earlier point in time than the patient sample, optionally wherein the control sample is obtained before the patient has received immune checkpoint therapy and the patient sample is obtained after the patient has received immune checkpoint therapy.

3. The method of claim 1, wherein the control sample comprises cells or does not comprise cells.

4. The method of claim 1, wherein the control sample comprises cancer cells known to be responsive or non-responsive to the immune checkpoint therapy.

5. The method of claim 1, wherein
   a) the subject sample and/or the control sample has not been contacted with a renal cell cancer treatment or inhibitor of an immune checkpoint;
   b) the subject has not been administered a renal cell cancer treatment or inhibitor of an immune checkpoint; and/or
   c) the subject sample is selected from the group consisting of serum, whole blood, plasma, urine, cells, cell lines, and biopsies.

6. The method of claim 1, further comprising recommending, prescribing, or administering at least one additional anti-cancer therapeutic agent, optionally wherein the at least one additional anti-cancer therapeutic agent is an anti-PD-1 antibody and/or an anti-CTLA4 antibody.

7. The method of claim 1, wherein the amount of ARID2 is detected using a reagent which specifically binds with ARID2 protein, optionally wherein the reagent is selected from the group consisting of an antibody, an antibody derivative, and an antibody fragment.

8. The method of claim 1, wherein the amount of ARID2 is assessed by detecting the presence in the sample of a transcribed polynucleotide or portion thereof, optionally wherein
   a) the transcribed polynucleotide is an mRNA or a cDNA;
   b) the step of detecting further comprises amplifying the transcribed polynucleotide; and/or
   c) the transcribed polynucleotide is detected by identifying a nucleic acid that anneals with ARID2 nucleic acid, or a portion thereof, under stringent hybridization conditions.

9. The method of claim 1, wherein the immune checkpoint therapy comprises an anti-PD-1 antibody or an anti-CTLA4 antibody.

10. The method of claim 1, wherein the likelihood of the cancer in the subject to be responsive to immune checkpoint therapy is the likelihood of at least one criteria selected from the group consisting of cellular proliferation, tumor burden, m-stage, metastasis, progressive disease, clinical benefit rate, survival until mortality, pathological complete response, semi-quantitative measures of pathologic response, clinical complete remission, clinical partial remission, clinical stable disease, recurrence-free survival, metastasis free survival, disease free survival, circulating tumor cell decrease, circulating marker response, and RECIST criteria.

11. The method of claim 1, wherein the cancer is a solid tumor.

12. The method of claim 1, wherein the cancer is selected from the group consisting of melanoma, lung cancer, head and neck squamous cell carcinoma (HNSCC), sarcoma, bladder cancer, and renal cell cancer, optionally wherein the cancer is melanoma and/or wherein the cancer is metastatic.

13. The method of claim 1, wherein the subject is a mammal, optionally wherein the mammal is an animal model of cancer, or a human.

* * * * *